(12) United States Patent
Abudayyeh et al.

(10) Patent No.: US 12,012,621 B2
(45) Date of Patent: Jun. 18, 2024

(54) SYSTEMS, METHODS, AND COMPOSITIONS FOR RNA-GUIDED RNA-TARGETING CRISPR EFFECTORS

(71) Applicant: MASSACHUSETTS INSTITUTE OF TECHNOLOGY, Cambridge, MA (US)

(72) Inventors: Omar Abudayyeh, Cambridge, MA (US); Jonathan Gootenberg, Cambridge, MA (US)

(73) Assignee: Massachusetts Institute of Technology, Cambridge, MA (US)

( * ) Notice: Subject to any disclaimer, the term of this patent is extended or adjusted under 35 U.S.C. 154(b) by 0 days.

(21) Appl. No.: 17/365,777

(22) Filed: Jul. 1, 2021

(65) Prior Publication Data
US 2022/0073891 A1    Mar. 10, 2022

Related U.S. Application Data

(60) Provisional application No. 63/208,606, filed on Jun. 9, 2021, provisional application No. 63/073,898, filed on Sep. 2, 2020.

(51) Int. Cl.
*C12N 9/22* (2006.01)
*A61K 38/00* (2006.01)
(Continued)

(52) U.S. Cl.
CPC ............. *C12N 9/22* (2013.01); *A61K 48/005* (2013.01); *C12N 9/78* (2013.01); *C12N 15/102* (2013.01);
(Continued)

(58) Field of Classification Search
CPC .......... C12N 9/22; C12N 9/78; C12N 15/102; C12N 15/11; C12N 15/63; C12N 2310/20;
(Continued)

(56) References Cited

U.S. PATENT DOCUMENTS

2016/0208243 A1    7/2016   Zhang et al.

FOREIGN PATENT DOCUMENTS

| EP | 3009511 A2 | 4/2016 |
| WO | 20150184016 A2 | 12/2015 |

(Continued)

OTHER PUBLICATIONS

Krishna (et al. 2006. A tale of two ferredoxins: sequence similarity and structural differences. BMC Struct. Biol. 6:8) (Year: 2006).*

(Continued)

*Primary Examiner* — Kimberly Chong
*Assistant Examiner* — Ruth Sophia Arieti
(74) *Attorney, Agent, or Firm* — Lathrop GPM LLP; Laura A. Labeots

(57) ABSTRACT

This disclosure provides systems, methods, and compositions for RNA-guided RNA-targeting CRISPR effectors for the treatment of diseases as well as diagnostics. In some embodiments, nucleotide deaminase functionalized CRISPR systems for RNA editing RNA knockdown, viral resistance, splicing modulation, RNA tracking, translation modulation, and epi-transcriptomic modifications are disclosed.

17 Claims, 142 Drawing Sheets

Specification includes a Sequence Listing.

| Property | type III-A/B complex | Cas7-11 | Cas13 |
|---|---|---|---|
| Complex identity | multi component | single effector | single effector |
| processing activity | accesory protein (Cas6) | in effector | in effector |
| Rnase/Dnase | Rnase and DNase activity | RNase only | RNase only |
| mammalian activity | no | yes | yes |
| DR structure | short, unstructured | short, unstructured | hairpin |
| Cleavage mechanism | multiple cuts *in cis* | multiple cuts *in cis* | collateral activity in *trans* |
| catalytic domains | RAMP (acidic) | RAMP (acidic) | HEPN (basic) |
| Sequence constraint | no PFS | no PFS | PFS constraint |

(51) Int. Cl.
- *A61K 48/00* (2006.01)
- *C12N 9/78* (2006.01)
- *C12N 15/10* (2006.01)
- *C12N 15/11* (2006.01)
- *C12N 15/63* (2006.01)
- *C12Q 1/6825* (2018.01)

(52) U.S. Cl.
CPC .............. *C12N 15/11* (2013.01); *C12N 15/63* (2013.01); *C12Y 305/04004* (2013.01); *C12Y 305/04005* (2013.01); *A61K 38/00* (2013.01); *C07K 2319/85* (2013.01); *C12N 2310/20* (2017.05); *C12N 2320/10* (2013.01); *C12N 2320/33* (2013.01); *C12Q 1/6825* (2013.01)

(58) Field of Classification Search
CPC ............ C12N 2320/10; C12N 2320/33; A61K 48/005; A61K 38/00; C12Y 305/04004; C12Y 305/04005; C07K 2319/85; C12Q 1/6825
See application file for complete search history.

(56) References Cited

FOREIGN PATENT DOCUMENTS

| WO | 2019060746 | A1 | | 3/2019 | |
|---|---|---|---|---|---|
| WO | 2019222555 | A1 | | 11/2019 | |
| WO | WO-2019222555 | A1 | * | 11/2019 | ......... A61K 31/7088 |

OTHER PUBLICATIONS

Wang (and Li. 2012. The mysterious RAMP proteins and their roles in small RNA-based immunity. Protein Sci. 21:463-470) (Year: 2012).*
Doudna and Charpentier. 2014. The new frontier of genome engineering with CRISPR-Cas9. Science 346(6213):1258096 (Year: 2014).*
IDS NPL document #5 (Anonymous: "hypothetical protein KSU1_C0135 [Candidatus Jettenia caeni]—Protein—NCBI", GenBank, Sep. 5, 2015; of record) (Year: 2015).*
Thurtle-Schmidt and Lo. 2018. Molecular Biology at the Cutting Edge: A Review on CRISPR/CAS9 Gene Editing for Undergraduates. Biochem. Molec. Biol. Educat. 46(2):195-205 (Year: 2018).*
UniProt (Accession I3IJ36 version 26. Jul. 31, 2019. Accessible online at: https://www.uniprot.org/uniprotkb/I3IJ36/entry. Accessed Jul. 20, 2023; "Uniprot") (Year: 2019).*
U.S. Appl. No. 18/234,680, filed Aug. 16, 2023.*
U.S. Appl. No. 18/455,380, filed Aug. 25, 2023.*
PCT Application No. PCT/US2021/040160 Written Opinion dated Mar. 10, 2022, 10 pages.
PCT Application No. PCT/US2021/040160 International Search Report dated Mar. 10, 2022, 8 pages.
Anonymous: "Candidatus Jettenia caeni DNA, contig: KSU1_C, whole genome shotgun se—Nucleotide—NCBI", Sep. 15, 2015 (Sep. 15, 2015), XP055853309.
Zhao Yunpeng et al: "Genome-centered omics insight into the competition and niche differentiation ofCa. JetteniaandCa. Brocadiaaffiliated to anammox bacteria", Applied Microbiology and Biotechnology, Springer Berlin Heidelberg, Berlin/Heidelberg, vol. 103, No. 19, Sep. 3, 2019 (Sep. 3, 2019), pp. 8191-8202.
Anonymous: "hypothetical protein KSU1_C0135 [Candidatus Jettenia caeni]—Protein—NCBI", GenBank, Sep. 15, 2015 (Sep. 15, 2015).
Michal Burmistrz et al: "RNA-Targeting CRISPR-Cas Systems and Their Applications", International Journal of Molecular Sciences, vol. 21, No. 3, Feb. 7, 2020 (Feb. 7, 2020), p. 1122.
Makarova Kira Set al: "Evolutionary classification of CRISPR-Cas systems: a burst of class 2 and derived variants", Nature Reviews Microbiology, Nature Publishing Group, GB, vol. 18, No. 2, Dec. 19, 2019 (Dec. 19, 2019), pp. 67-83.
Kira S. Makarova et al: "Classification and Nomenclature of CRISPR-Cas Systems: Where from Here?", The CRISPR Journal, vol. 1, No. 5, Oct. 17, 2018 (Oct. 17, 2018), pp. 325-336.
Zheng Ye University of California et al: "Substrate Recognition and Novel Substrate Discovery for Human Adenosine Deaminase that Acts on Double-Stranded RNA", Dissertation Submitted in Partial Satisfaction of the Requirements for the Degree of Doctor of Philosophy in Chemistry in the Office of Graduate Studies of the University of California, University of California, US, Jan. 1, 2017 (Jan. 1, 2017), pp. 1-140.
Rationally engineered Cas9 nucleases with improved specificity, Slaymaker et al. (2016), Science, 351(6268):84-88.
GeneMarkS: a self-training method for prediction of gene starts in microbial genomes. Implications for finding sequence motifs in regulatory regions. John Besemer, Alexandre Lomsadze and Mark Borodovsky, Nucleic Acids Research (2001) 29, pp. 2607-2618.
PILER-CR: fast and accurate identification of CRISPR repeats, Edgar, R.C., BMC Bioinformatics, Jan. 20;8:18(2007).
Wong et al., RNA 7:846-858 (2001).
Makarova et al., Supplemental Information (46 pages) for "Evolutionary classification of CRISPR-Cas systems: a burst of class 2 and derived variants", Nature Reviews Microbiology, Dec. 19, 2019, 18(2): 67-83. [Original non-patent literature document submitted with Mar. 3, 2023 IDS.].

* cited by examiner

| Property | type III-A/B complex | Cas7-11 | Cas13 |
| --- | --- | --- | --- |
| Complex identity | multi component | single effector | single effector |
| processing activity | accesory protein (Cas6) | in effector | in effector |
| Rnase/Dnase | Rnase and DNase activity | RNase only | RNase only |
| mammalian activity | no | yes | yes |
| DR structure | short, unstructured | short, unstructured | hairpin |
| Cleavage mechanism | multiple cuts *in cis* | multiple cuts *in cis* | collateral activity in *trans* |
| catalytic domains | RAMP (acidic) | RAMP (acidic) | HEPN (basic) |
| Sequence constraint | no PFS | no PFS | PFS constraint |

FIG. 1C

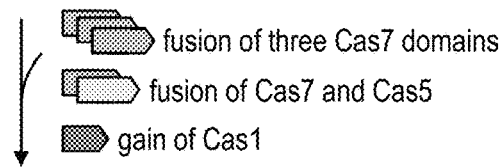
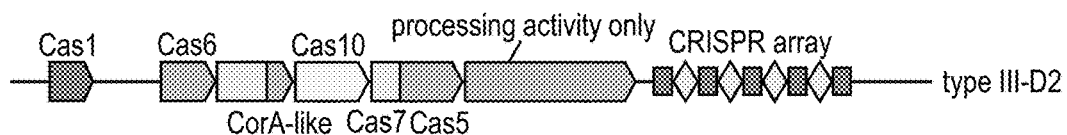
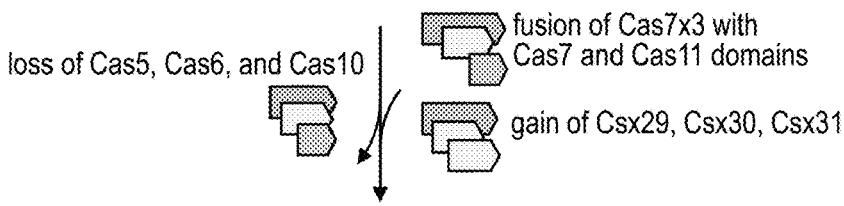
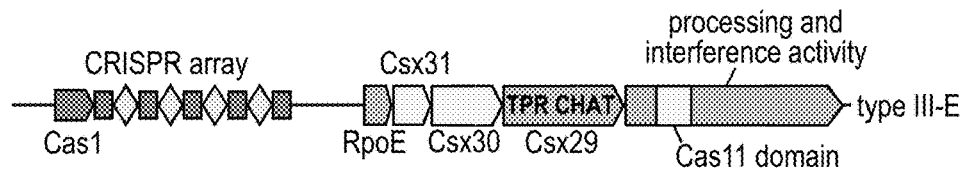

```
WmCas7x3      QRI--------------------TPDAPDADP-YWQADIALDADGRPYLPG
NisCas7x3     EEMDKQSG---------------ESVDKKQNN-SWIQAIALDLNKKPYIPG
GwCas7x3      E----------------------KERDENKET-RWLEAVALDHKGQPYIPG
HvmCas7x3     VTRP-------------------ELTVADRDELVDINAVVTDYTGKPYLPG
DsbCas7x3     TDRPGLEI---------------EQKDGSKVK-AEINAFIKDSNGKPYLPG
GamCas7x3     IPVT------I------------KDTQGKNRE-VEVNSVITGKAALPIIPG
DesCas7x3     VEHD-------------------LIKNDDGTP-VQINALITGAGGLPIIPG
GabCas7x3     AEIE------I------------NDSQGDRRQ-VQANAIIRGKIDDKPIIPG
MetCas7x3     CEHD-------------------DVKNNDGEP-VKINACIKGSKGRPIIPG
MebCas7x3     CYRP-------------------ELTNADQKP-VDINACIKGANNLPIIPG
GwCas7-11     -----------------------EGQKQTDDQAE-SLHLRTLRDGHGRFRIPF
HreCas7-11    -----------------------SEGQTS-----QAIILCPDGSYRLPR
CmaCas7-11    -----------------------KTSHTR-----STIFLNMNGQFCIPR
HvmCas7-11    -----------------------QEGQTS-----ATILLNRDGYFRLPR
SmCas7-11     -----------------------PIDDDQTS---SRTIVDRDGRYRLPR
OmCas7-11     -----------------------GSHDHTS----RKILLTRDFYYRLPR
DisCas7-11    -----------------------EDAKQTD----LQVLLTPDNKYRLPR
DsbaCas7-11   -----------------------KEKKQTD----LMLILDGQNHYRIPR
SstCas7-11    -----------------------EDAKHTN----LKVLLDRQNRYRLPR
SybCas7-11    -----------------------GAGGHTD----LSILLGKDGHYRVPR
CsbCas7-11    SDSIPGKEK--------------KSEDSLVINEHTS---FNILLDKENRYRIPR
CjcCas7-11    FDSTQDDLDLVPDIVNTDEKLEANEQTS----FRILMDKKGRYRIPR
CbfCas7-11    -----------------------EQTEEVEHTS---LRLVMDKKGRFRLPR
HvsCas7-11    -----------------------DEEKAE-----GAILLTPDNRFRLPR
HsmCas7-11    -----------------------KTEEQID----MQILLTKDGRYRLPR
FmCas7-11     -----------------------QAGKQTS----MPTLQDSNDHFRLPR
DpbaCas7-11   -----------------------ATETHTD----LPILLTSDRHFRIPR
```

FIG. 1G

| | | | |
|---|---|---|---|
| WmCas7x3 | HRKPQDNAPDGTPRQRGDRA------------------------------- | ---------- | LIPGASLRCRLRS |
| NisCas7x3 | KKDEAKNEADAKPRTNHQGQV------------------------------- | ---------- | ILPASSLRGRLRA |
| GwCas7x3 | KADDADAV----PRRTHDDKI------------------------------- | ---------- | VLPASSLRGRLRT |
| HvmCas7x3 | KKKRRSNTPNLRPLRDAIGRP------------------------------- | ---------- | CLPESSVRCALRA |
| DsbCas7x3 | KKRKED--IDHQPLRDSAGNA------------------------------- | ---------- | RLPAKSIRCAMRS |
| GamCas7x3 | DKCKAEDTPDIYPLEEKNGVP------------------------------- | ---------- | AFPVRSFRCAIRS |
| DesCas7x3 | NTPDITQAPDMVPLVDEDGNP------------------------------- | ---------- | MLPASSFRCALRA |
| GabCas7x3 | SKGDGDQPAVHQPLTDRSNNP------------------------------- | ---------- | ILPARSFRCAIRA |
| MetCas7x3 | LSSNE AKTDHYPLLDKNRNP------------------------------- | ---------- | YLPVSSFRCVLRS |
| MebCas7x3 | LEADPKTKIDHYPLLDNHKKP------------------------------- | ---------- | RLPSASIRGVLRS |
| GwCas7-11 | ESDAPDNVAYKKPVVQYDETGRLRTTDPGPVEMLTCLKGEGVRCVVAY | | |
| HreCas7-11 | DHDNKDAVMVQKTVLFVDESG------- | NYSQMPHHFLKGSGIRCACRF | |
| CmaCas7-11 | DNRNPDAVMVKKTILVYEQDSSTHKNVPKEVPKY- | FIKSETIRCILRS | |
| HvmCas7-11 | DPRNTDAIMVRKTVFCPDPNA- | KNRPAPATVY- | MIKGESIRCILRS |
| SmCas7-11 | NSDTADIISFRRTVVDNGEVL------- | REP-------- | VLRGEGLRCLLRT |
| OmCas7-11 | -RHEEDSVYFQKRIFTSDGRV------- | VLVP------- | ALRGEGLRCLLRT |
| DisCas7-11 | DKRGTDVVTFVKYKAEGEEAK------- | PVC-------- | AYKAESFRCVIRS |
| DsbaCas7-11 | TEDVADIVSFKKYTQGGEKITY------------- | -------- | AYKSESFRCVVRT |
| SstCas7-11 | EKDGSDIVSFRKYADDSGKEVY------------- | -------- | AYKAESFRCVVRA |
| SybCas7-11 | ERIGFDNIAYEKRRYNGETNT------ | TESIP----- | AVKGETFRCIVRT |
| CsbCas7-11 | EPGNRDAIAYKKRVYNDGNNA------ | IEPEPRF--- | AVKSETHRCIFRT |
| CjcCas7-11 | NKDNIDCIAYEKRKWENGGIK-------- | FVP------- | TIKGETIRCIVRM |
| CbfCas7-11 | DPNNVDAIVFEKMKLDGDQVK-------- | YLP------- | ALKGETIRCIVRT |
| HvsCas7-11 | EGKAPDAVFFKKYVFENGKIE-------- | EKP------- | CFKAESIRCIFRT |
| HsmCas7-11 | DSSNTDLVTFKKYKLEESKEVF------------- | -------- | AIKGESIRCVFRT |
| FmCas7-11 | -HGNTDSVFYKKPILKSGEKE-------- | PSYQW----- | AIKSDTVRCLIRS |
| DpbaCas7-11 | -RNESDAVFYQKSVAGEKGPVY------------- | -------- | ALKGEGLRCIVSS |

FIG. 1H

| | | | | |
|---|---|---|---|---|
| WmCas7x3 | PATLVDHDMAIDRFTGCCKGAKFK | ---------- | TRYAECP- | TLEGQLSDL |
| NisCas7x3 | LATLTRHEMVAIDRFTGCCKGAKH- | ---------- | DYIECP- | TLTGAIYDL |
| GwCas7x3 | SIKTRRHEMVAIDRFTGCCKGAKH- | ---------- | DYVECP- | TLACKLSDL |
| HvmCas7x3 | EDCDNIQEFVAIDRFTGCCKKAKH- | ---------- | EYIGSP- | RFTGTIADK |
| DsbCas7x3 | TRQETVQDFVAIDRFHGCCKTAKD- | ---------- | SFSWRP- | QYSLMHPS |
| GamCas7x3 | LKPFIIQEFVAIDRFHGCCKEAKH- | ---------- | AHYQAP- | VFKGKVRSQ |
| DesCas7x3 | FRREQEQTFVAIDRFHGCCKGALT- | ---------- | RHAESP- | RFEGHLVDP |
| GabCas7x3 | YRPAKTQQFVAIDRFHGCCKGALS- | ---------- | KYFERP- | VLKGGISKL |
| MetCas7x3 | KSKKTKQDFVAIDRFHGCCKGAKD- | ---------- | THFERP- | EFEGAISFSP |
| MebCas7x3 | ANELKTQEFVAIDRFHGCCKGAKH- | ---------- | KHSERP- | YFQGRITSP |
| GwCas7-11 | TPHAMRSDRVADVE-GCMPEAKEDDRPL | ASPGK | PLNFKSTIWYRE | |
| HreCas7-11 | EVEAIKCDHVAIDRFHGCTVHRMKDDYPLPGSPNRP | LRIKGNIW | KR | |
| CmaCas7-11 | NVSDCCIDHVAIDRFTGCCVKMIEDYPLSASPKNCLNLK | GSIW | TS | |
| HvmCas7-11 | SVSDKKMDHVAIDRFHGCCVQMKEDDYPLPGCPAQ | LILEGKFW | KD | |
| SmCas7-11 | TVADKRLDHVAIDRFDQSV--KDDRPL | GSPKQ | PLVFKGCFW | QT |
| OmCas7-11 | TWNDKKIDHVSCSRFDISV--KEDDRSL | GSPDS | PLHFEGTFW | HR |
| DisCas7-11 | DPEPVTFDHVAIDRFTGCAKKKEDDSPL | PGSPARP | LMLKGSFW | RR |
| DsbaCas7-11 | EPEPRRFDHVAIDRFTGCVQKKFDDRSL | PGKEGFMTLIG | CFWMRK | |
| SstCas7-11 | QPEPMIFDHVAIDRFTGCVKKKFDDCSLPGTPGHP | LTLKG | CFW | RK |
| SybCas7-11 | AWTRKHLDHVAIDRFHGCENMKFDTYAL | ASPTNP | LRMKGLIW | RS |
| CsbCas7-11 | EKLEKHIDHVAIDRFTGCLKAKEDTYPL | GSPKKP | LKLKGRFW | KK |
| CjcCas7-11 | SYKKKLIDHVAIDRFHGCEKMKH-TLPL | GSFEKP | IILKGRFW | KK |
| CbfCas7-11 | KDIAKKIDHVAIDRFTGCRQMKFDTLPL | GSPERP | LRLKGLFWMRR | |
| HvsCas7-11 | GQEEKFFDHVAIDRFTGCKKYKFDDKPI | GAPDTP | IVLEGKIW | KK |
| HsmCas7-11 | DSAPKRLDHVAIDRFTGCKQAKEDDSPL | GTSKHP | LVFKGMFW | RD |
| FmCas7-11 | EIKTYRMDHVAIDRISGCVQCKDDEPL | GTSKHP | LVFKGMFW | NR |
| DpbaCas7-11 | EVREKLFDHVSIDRFTGCAKLKEDDKPL | G----NPLVFQGVFW | HQ | |

FIG. 11

| | | | | |
|---|---|---|---|---|
| WmCas7x3 | PVAGxAxQNQPAIP | TSxRCLxSSxFESxSSxGSNLR | LHPTPYSIRxTT |
| NisCas7x3 | EARPxKxNGKHAIP | TSxRGMxSxxFESxSxxNSNER | LHPEHYSVRxSL |
| GwCas7x3 | SLHPxKxNNGLAIP | TSxRGMxSxxFESxSxxNSNFR | LDxKTYSMRxTM |
| HvmCas7x3 | EILPxTxGGKPAIP | TSxRCMxSxxAExSxxNSSLR | LExKTLSYRxSM |
| DsbCas7x3 | QVDHxTENGEIAIP | TTxRCLxSSxSExSxxSMRxLD | GMMSYRQPV |
| GamCas7x3 | LRHPxQxDGEPAIP | STSxRCLxSxxMTExSxxANCAMRxLD | SEIISYRxPM |
| DesCas7x3 | RIENxRxGNRIAIP | ASxRGMxSxxAExSxxNSAMRxLH | GILSYRxKA |
| GabCas7x3 | LKEHxQxNNKLAIP | TSxRCLxSxxAExSxxNSAIRxLD | GVLSYRxPA |
| MetCas7x3 | EINNxRxNGELAIP | TSxRCMxSxxAExSxxNSAMRxLD | GLLSYRxTA |
| MebCas7x3 | ELDNxRxNGQLAIP | TSxRGMxSxxAExSxxNSAMRxLD | GLLSYRxDA |
| GwCas7-11 | TQRFHQxNDEIGxP | ASxRGMxTxxSNYQxTxxNSCYRNLKATEEITR | MP |
| HreCas7-11 | NYRFxRxNDELAIP | SExRCMxSxxYExxxxNSCFRxMExGRYLSRxMG |  |
| CmaCas7-11 | NYAFxRxNDHIAIP | ASxRCMxSxxFETxxxxHSCFRxMDxKKYLTRxVI |  |
| HvmCas7-11 | NYGFxRxNGNVAIP | SSxRCMxSxxFExSxxxNSCFRxFDxERYLSRSEK |  |
| SmCas7-11 | NFPFxKxNDEIMxP | APxWxAxSQxYExxxxNSCFRxMKxKRFLSWxME |  |
| OmCas7-11 | EYPSxRxNNTPMIP | AGxRxAxSQxYExxxxNSCIRxMDxGQTLSWxMS |  |
| DisCas7-11 | SYAFxRxHKQIMIP | SExRCMxSSxYETxxxxNSCFRxFDxTKRLSWxMD |  |
| DsbaCas7-11 | SYRFxTxNRVPMIP | SExRCMxSxxYExxxxNSCFRxFDxKYRLSWxMD |  |
| SstCas7-11 | SYAFxSxNGDIMxP | SExRCMxSxxYExxxxNSCFAxFDxGYRLSWxME |  |
| SybCas7-11 | MCKFxSxAGKPMIP | SExRCMxSxxYExRxHFExxxxKSCFAxFGxEKYLTRxVQ |  |
| CsbCas7-11 | NYKFxRxNGELMIP | SExRCMxSxxYExxxxNSCFRxFDxDSTLSWxMN |  |
| CjcCas7-11 | NYQFxHxNDEIMxP | SExRGMxSxxYExxAxMxxxxNSCFRxYDxTKYITRxLS |  |
| CbfCas7-11 | TYDFxQMNNAIMIP | SExRGMxSAxYExxxxNSCFRxFHxKQYLTRxIS |  |
| HvsCas7-11 | YYHFLKxDNKPIIP | AExRCAxSxxYExxxxNSCFRxFGxKKVLSWxME |  |
| HsmCas7-11 | VYKFxRxGGHLCIP | AExRCMxSxxYExxxxNSCFRxFDxKRLISWxMT |  |
| FmCas7-11 | SFRFxRxDDEVLIP | SExRCMxSxxFExxxxGSCFRxINxKAHLSWxIN |  |
| DpbaCas7-11 | RFKFMRMGSQAAIP | SAxRSMTSxxFExxxxNSCFRxLDxKSHLSWxME |  |

FIG. 1J

| | | | |
|---|---|---|---|
| WmCas7x3 | E----------------------- | ------ALSA--- | ICRI-VE----RNGELK YPL |
| NisCas7x3 | DYV--------------------- | ------ALSA--- | MCRI-VD----DQGELK QPL |
| GwCas7x3 | Q----------------------- | ------SLSA--- | MCRI-VR----HDQKLY LPL |
| HvmCas7x3 | ANRN-------------------- | ---EDKPLSA--- | ICMI-KKIETGDKVEYR LPL |
| DsbCas7x3 | SG---------------------- | ------SLSA--- | ICMV-VI----RDGKKF YPL |
| GamCas7x3 | PSH--------------------- | ------ILSA--- | ICMI-TK----RGEDFW IPL |
| DesCas7x3 | N----------------------- | ------ALRE--- | ICMI-VL----RDGKRF LPL |
| GabCas7x3 | R----------------------- | ------ALRK--- | ICIL-FK----REEQWR VQM |
| MetCas7x3 | R----------------------- | ------ALRK--- | VCMV-IY----VDNKSF IKL |
| MebCas7x3 | L----------------------- | ------ALSK--- | ICITFIN----RQGQWQ IPM |
| GwCas7-11 | DEA--------------------- | ------KYRK--- | AGRV-TVSGDGAQKKYS QEM |
| HreCas7-11 | D----------------------- | ---EFKDFHPCI- | -----------VDGAK REM |
| CmaCas7-11 | ESETTQ-KRKKSGRYQVEESDPDLF | ------------- | PCR -QK----KGNKYK EKM |
| HvmCas7-11 | DPT--------------------- | ---ELTKYYPCK- | -----------KR----DGNKFF LKM |
| SmCas7-11 | E----------------------- | ----DYKDFYPCR | -----------LDGGKQ KKM |
| OmCas7-11 | SEHK-------------------- | --------DYQ-- | PCK -------TDNGRK QPM |
| DisCas7-11 | DHQN-------------------- | ----VLQDFLPCR | -----------TADGKH QKF |
| DsbaCas7-11 | DVK--------------------- | ----ELEQFKPCR | -----------ADDGKR EEM |
| SstCas7-11 | DRN--------------------- | ----VLMQFKPCR | -----------TDNGLR EEM |
| SybCas7-11 | KKGA-------------------- | ---KSSELVPCI- | VWG-QNGGLAVQQV |
| CsbCas7-11 | DEKDYKIDSNSIRKMESQRNPKYRI | --PDE QKELRNSGNGLFNRLY |
| CjcCas7-11 | EKKD---ESNDKNKSQDDASQKIR- | -KGL -KK----TDEGFS IEV |
| CbfCas7-11 | EDK--------------------- | ----ELREFIPCI | -RI----INGDVY EKA |
| HvsCas7-11 | KDAK-------------------- | --------EFM-- | PCR -SK----KKKGKLYMVKM |
| HsmCas7-11 | EEAK---RPDPKKSEEQNRMRFR-- | -PCR -IK----KDKKFY QEM |
| FmCas7-11 | DMAK-------------------- | --------HYR-- | PCR -IQ----NNEKMF QPY |
| DpbaCas7-11 | DDAG-------------------- | --------DYK-- | PCRF-EK----KDDKAV RKF |

FIG. 1K

DR processing

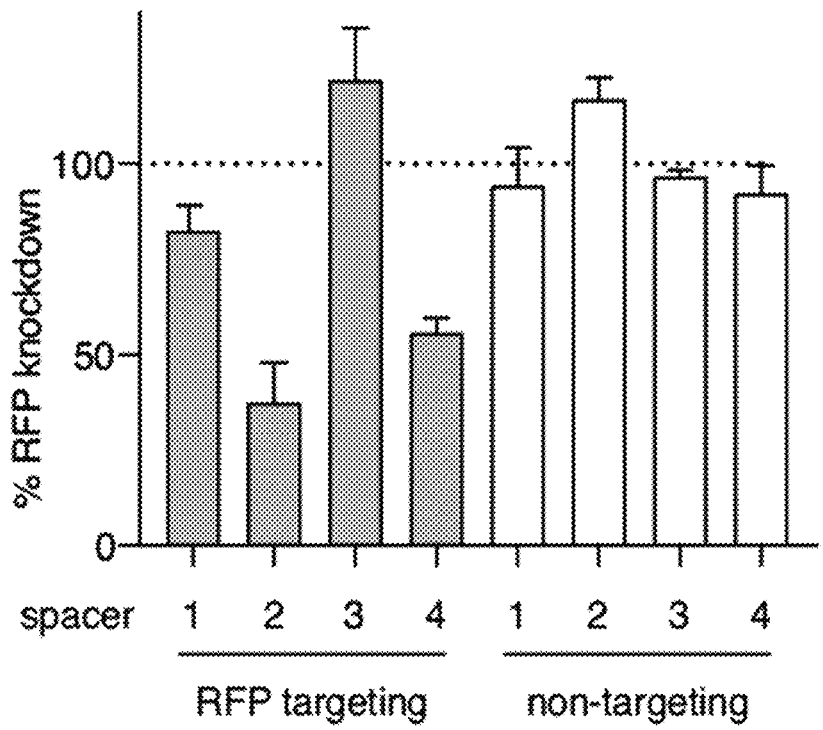
FIG. 3I
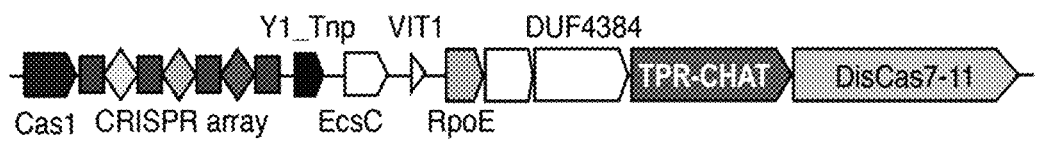
FIG. 3J

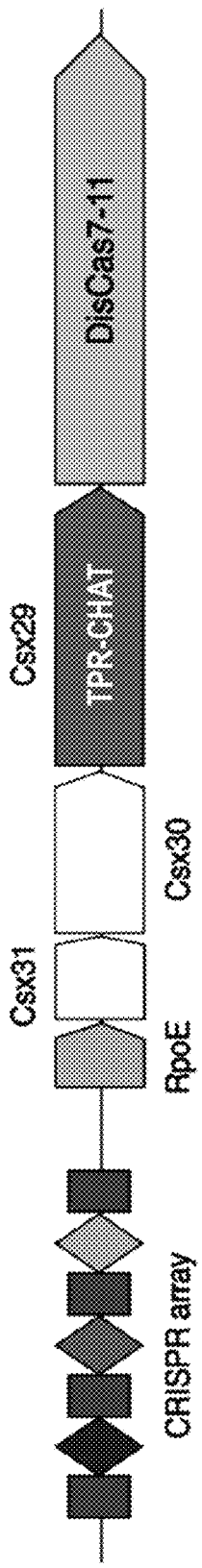
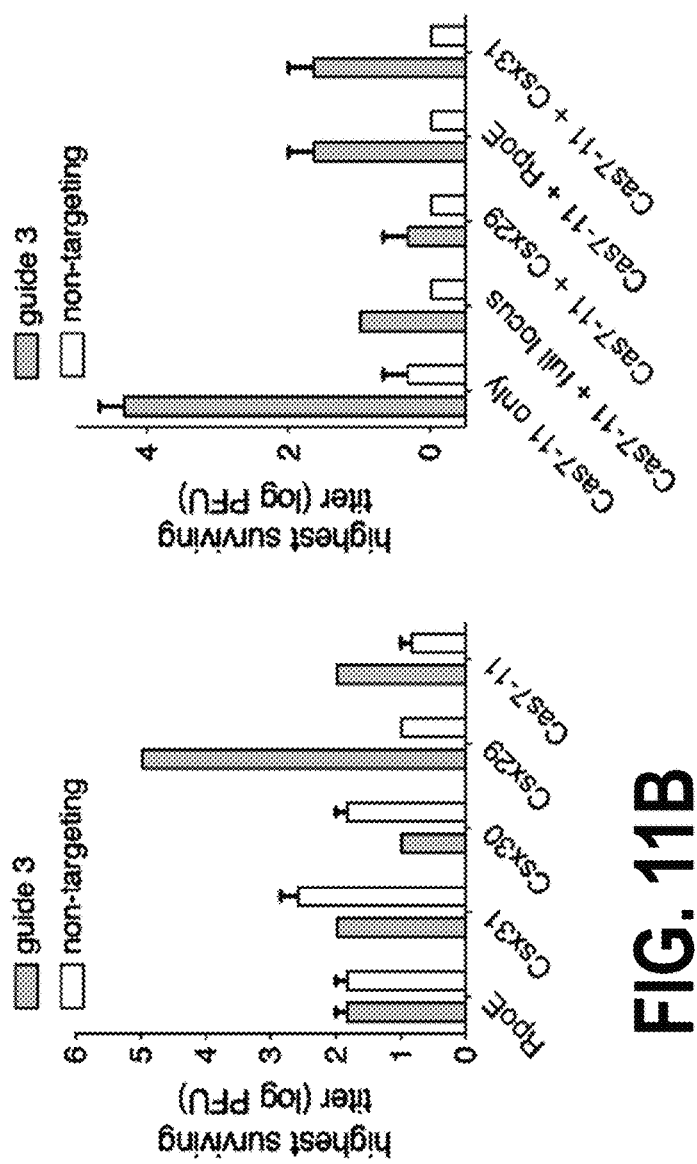
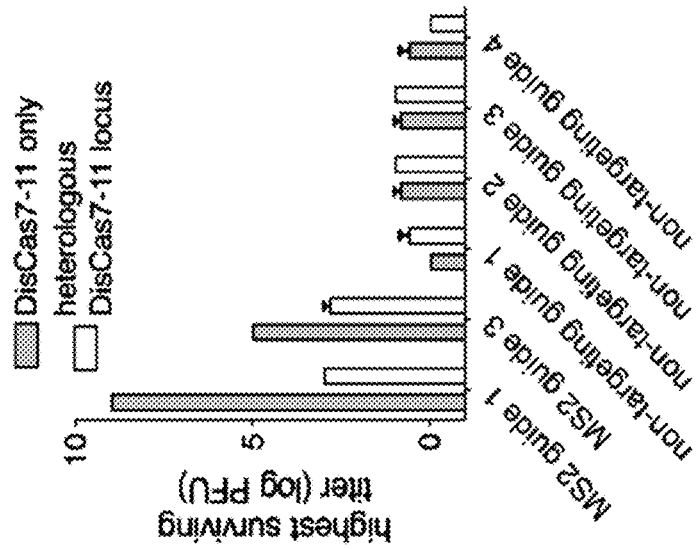
FIG. 11A
FIG. 11B

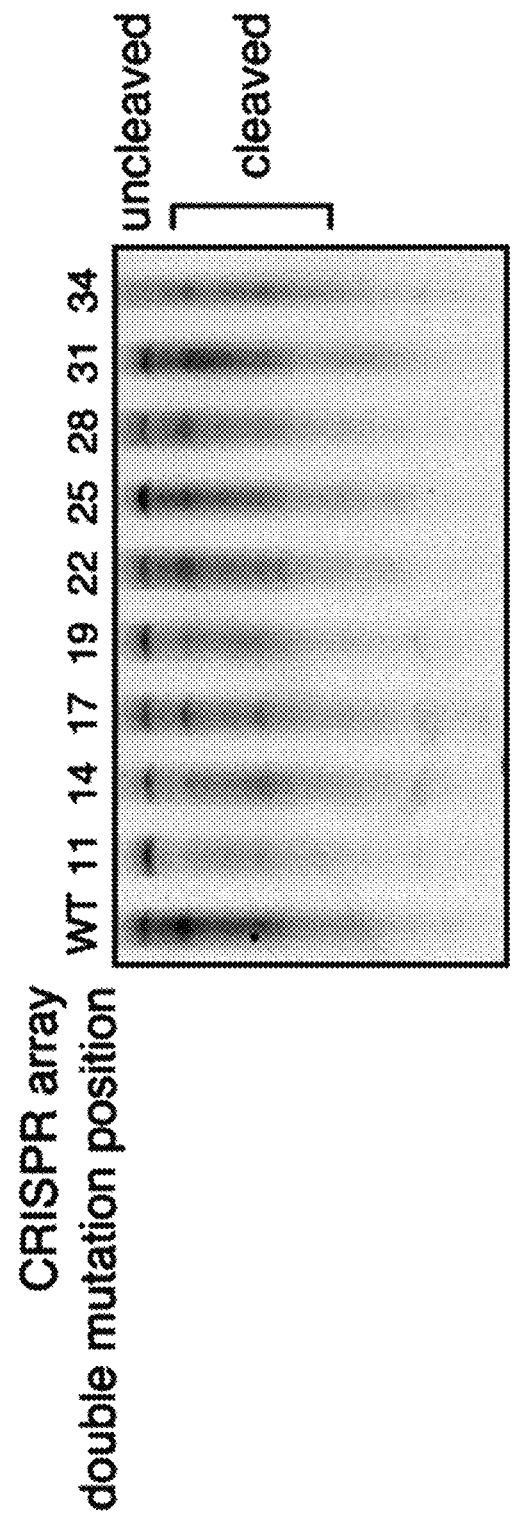

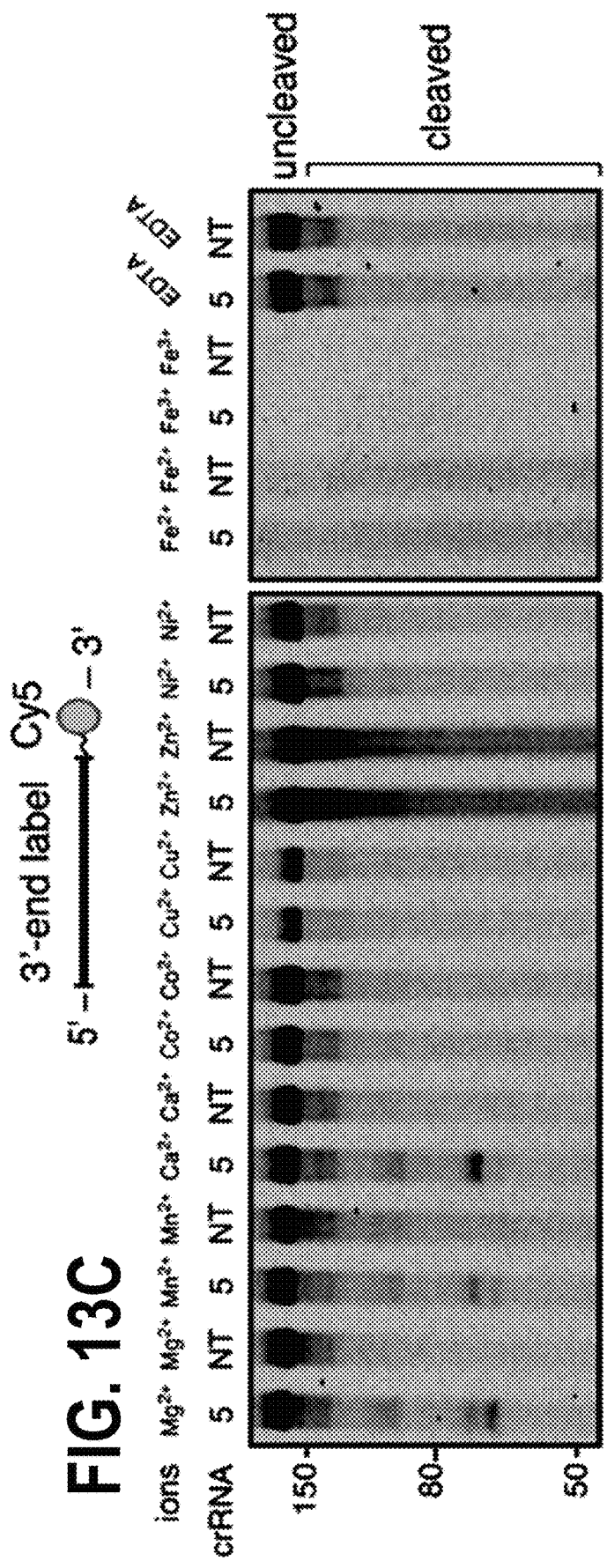
FIG. 13B
FIG. 13C

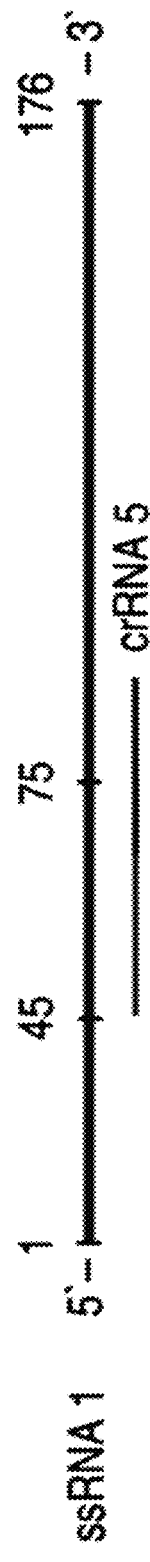
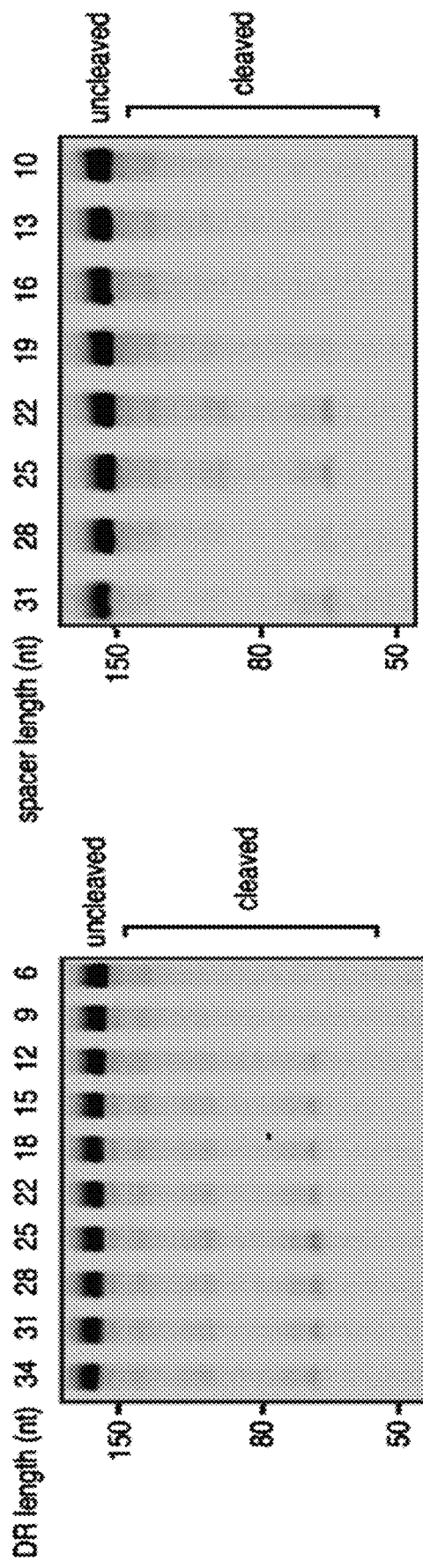
FIG. 14A
FIG. 14B

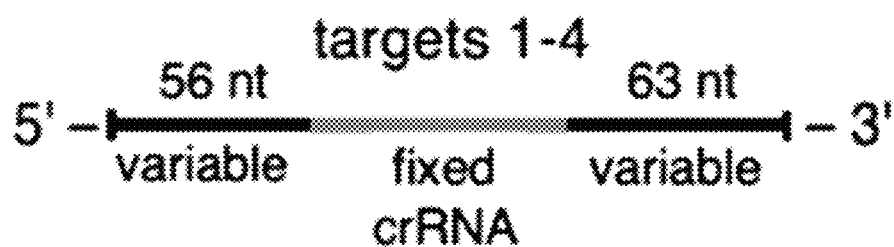
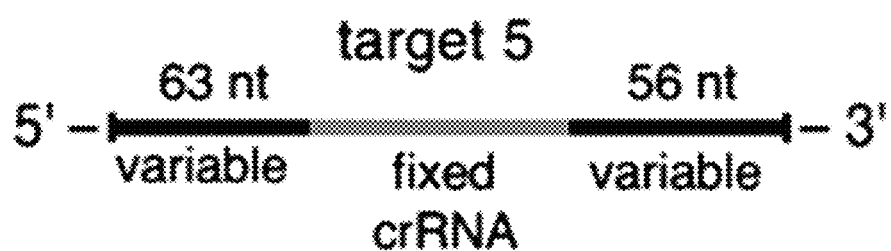
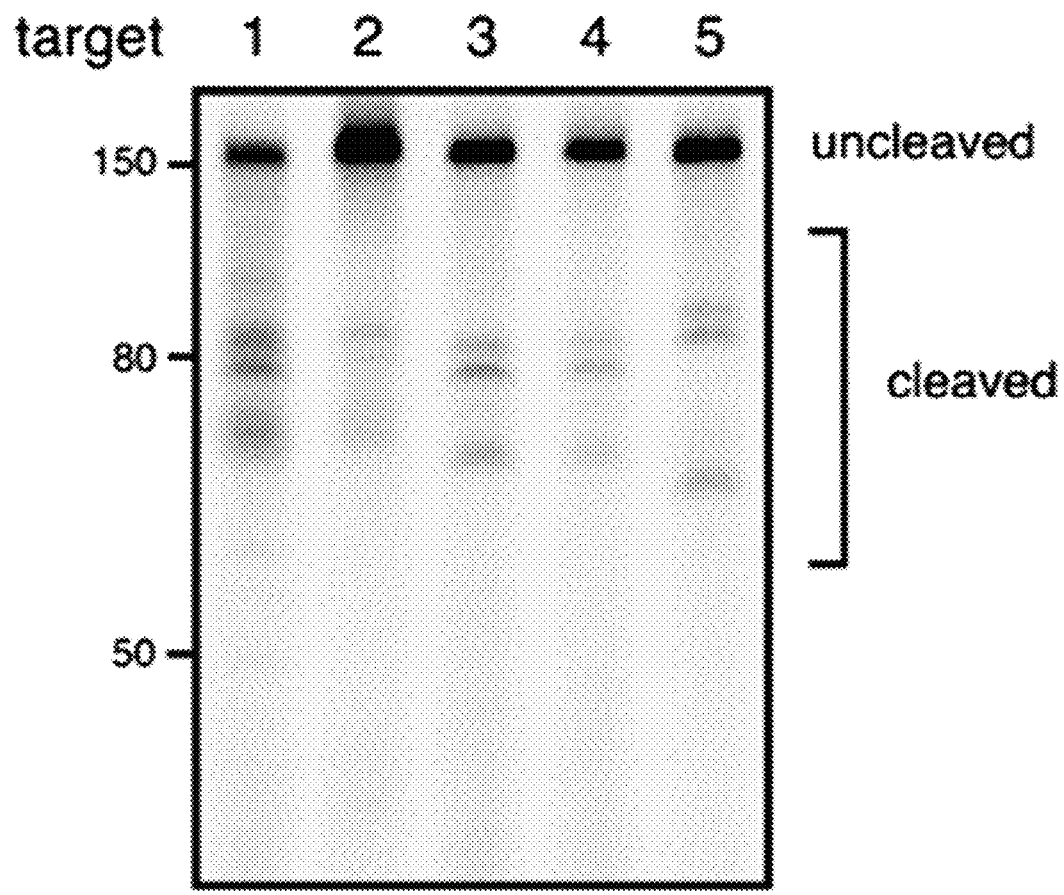
FIG. 18E

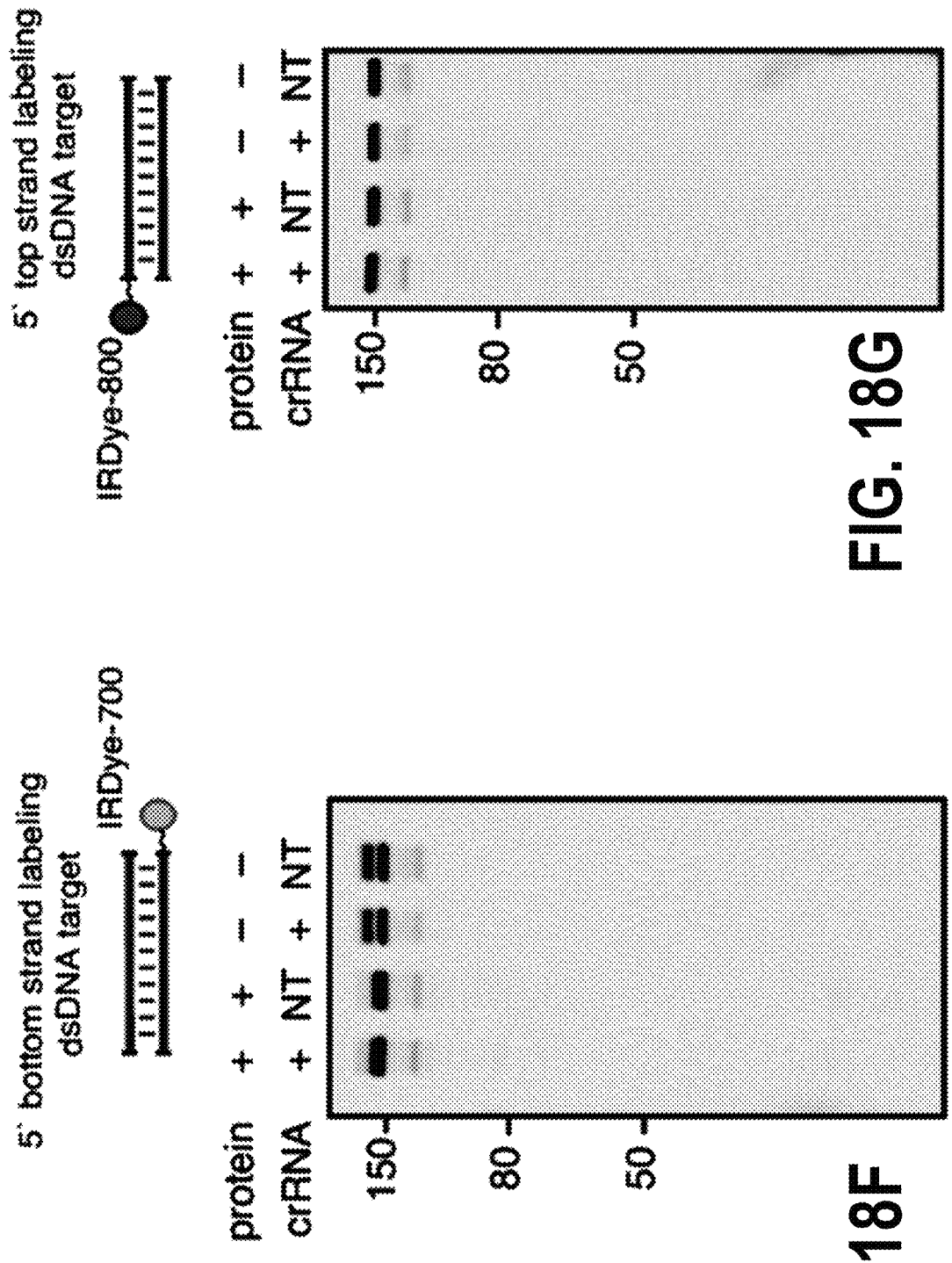

| sGuide # | Target | MM distance | Guide length | Guide sequence |
|---|---|---|---|---|
| 1 | Cluc W85X | 50 | 50 | catcctgcggcctctactctgcattcaattacatactgacacattcggca |
| 2 | Cluc W85X | 48 | 50 | accatcctgcggcctctactctgcattcaattacatactgacacattcgg |
| 3 | Cluc W85X | 46 | 50 | aaaccatcctgcggcctctactctgcattcaattacatactgacacattc |
| 4 | Cluc W85X | 44 | 50 | ctaaaccatcctgcggcctctactctgcattcaattacatactgacacat |
| 5 | Cluc W85X | 42 | 50 | ttctaaaccatcctgcggcctctactctgcattcaattacatactgacac |
| 6 | Cluc W85X | 40 | 50 | tgttctaaaccatcctgcggcctctactctgcattcaattacatactgac |
| 7 | Cluc W85X | 38 | 50 | aatgttctaaaccatcctgcggcctctactctgcattcaattacatactg |
| 8 | Cluc W85X | 36 | 50 | agaatgttctaaaccatcctgcggcctctactctgcattcaattacatac |
| 9 | Cluc W85X | 34 | 50 | atagaatgttctaaaccatcctgcggcctctactctgcattcaattacat |
| 10 | Cluc W85X | 32 | 50 | ccatagaatgttctaaaccatcctgcggcctctactctgcattcaattac |
| 11 | Cluc W85X | 30 | 50 | ttccatagaatgttctaaaccatcctgcggcctctactctgcattcaatt |
| 12 | Cluc W85X | 28 | 50 | ctttccatagaatgttctaaaccatcctgcggcctctactctgcattcaa |
| 13 | Cluc W85X | 26 | 50 | ctctttccatagaatgttctaaaccatcctgcggcctctactctgcattc |
| 14 | Cluc W85X | 24 | 50 | atctctttccatagaatgttctaaaccatcctgcggcctctactctgcat |
| 15 | Cluc W85X | 22 | 50 | gaatctctttccatagaatgttctaaaccatcctgcggcctctactctgc |
| 16 | Cluc W85X | 20 | 50 | tggaatctctttccatagaatgttctaaaccatcctgcggcctctactct |
| 17 | Cluc W85X | 18 | 50 | actggaatctctttccatagaatgttctaaaccatcctgcggcctctact |
| 18 | Cluc W85X | 16 | 50 | gaactggaatctctttccatagaatgttctaaaccatcctgcggcctcta |
| 19 | Cluc W85X | 14 | 50 | tggaactggaatctctttccatagaatgttctaaaccatcctgcggcctc |
| 20 | Cluc W85X | 12 | 50 | cctggaactggaatctctttccatagaatgttctaaaccatcctgcggcc |
| 21 | Cluc W85X | 10 | 50 | ttcctggaactggaatctctttccatagaatgttctaaaccatcctgcgg |
| 22 | Cluc W85X | 8 | 50 | ggttcctggaactggaatctctttccatagaatgttctaaaccatcctgc |
| 23 | Cluc W85X | 6 | 50 | caggttcctggaactggaatctctttccatagaatgttctaaaccatcct |
| 24 | Cluc W85X | 4 | 50 | accaggttcctggaactggaatctctttccatagaatgttctaaaccatc |
| 25 | Cluc W85X | 2 | 50 | gtaccaggttcctggaactggaatctctttccatagaatgttctaaacca |
| NT | Non-targeting | NA | 31 | GGTAATGCCTGGCTTGTCGACGCATAGTCTG |

FIG. 22B modulate protein function

KRAS S12G (A>I)

correction of mendelian disease (AVPR2 878G>A, Trp293Ter)
X-linked Nephrogenic diabetes insipidus

| initial codon | edited codon |
|---|---|
| Tyr | → Cys |
| stop | → Trp |
| His | → Arg |
| Gln | → Arg |
| Asn | → Ser / Asp |
| Lys | → Arg / Glu |
| Ser | → Gly |
| Arg | → Gly |
| Thr | → Ala |
| Met | → Val |
| Ile | → Met / Val |
| Asp | → Gly |
| Glu | → Gly |

FIG. 24A

FIG. 24B correction of mendelian disease (OTC 134T>C, Leu45Pro)
Ornithine carbamoyltransferase deficiency multiplexed creation of
disease-protective alleles modulate catalytic activity

CTSG H12G (C>Y)

alter post-translation modifications

CTNNB1 S33F (C>U)

| SEQ ID NO | Database | Genome/ Metagenome ID | Protein ID/Contig | Cas7-11 name |
|---|---|---|---|---|
| 1 | NCBI | NZ_BAFH01000003 | WP_007220849 | CjcCas7-11b |
| 2 | NCBI | JRYO01000185 | KHE91659 | CsbCas7-11b |
| 3 | NCBI | NBMK01000156 | OQY58162 | DsbaCas7-11a |
| 4 | NCBI | JPDT01001326 | KPA14974 | CmaCas7-11d |
| 5 | NCBI | NZ_BEXT01000001 | WP_124327589 | DisCas7-11a |
| 6 | NCBI | LAQJ01000233 | KKO18793 | CbfCas7-11b |
| 7 | NCBI | QMMU01000439 | RLC14096 | DpbaCas7-11a |
| 8 | NCBI | MGTA01000040 | OGR07205 | Dpba1Cas7-11d |
| 9 | NCBI | QMMU01000323 | RLC15988 | Dpba2Cas7-11d |
| 10 | NCBI | MVRP01000104 | OPY65763 | Sba1Cas7-11b |
| 11 | NCBI | QMMU01001221 | RLC02083 | Dpba3Cas7-11d |
| 12 | NCBI | QMMU01001221 | RLC02082 | Dpba4Cas7-11d |
| 13 | NCBI | MVRP01000104 | OPY65764 | Sba2Cas7-11c |
| 14 | NCBI | RFJP01000735 | RME63343 | NbaCas7-11b |
| 15 | JGI | 3300021493 | Ga0190306_10003932 | HvsCas7-11b |
| 16 | JGI | 3300019457 | Ga0193932_104825 | SstCas7-11a |
| 17 | JGI | 3300021508 | Ga0190283_10011062 | HvmCas7-11d |
| 18 | JGI | 3300005265 | Ga0073580_1036305 | HsmCas7-11b |
| 19 | JGI | 3300002821 | Iso3TCLC_1001005823 | HreCas7-11d |
| 20 | NCBI Metagenome | ASM579580v1 | SESD01000293.1 | FmCas7-11a |
| 21 | NCBI Metagenome | OBJA01000000 | OBJA01001127 | SmCas7-11c |
| 22 | NCBI Metagenome | OBEQ010000000 | OBEQ011807420 | GwCas7-11c |
| 23 | ENA | OVOO01000000 | OVOO01000106 | WmCas7-11c |
| 24 | ENA | PDWI01000000 | PDWI01005922.1 | OmCas7-11c |
| 25 | NCBI Metagenome | VAPF01001339.1 | - | HvmCas7x3 |
| 26 | NCBI | DRKI01000155.1 | HEB50754.1 | DesCas7x3 |
| 27 | NCBI | DRNY01000543.1 | HHJ20681.1 | GabCas7x3 |
| 28 | NCBI | DTXS01000070.1 | HID69069.1 | DsbCas7x3 |
| 29 | NCBI | JABFST010000317.1 | NOS89056.1 | MebCas7x3 |
| 30 | NCBI | PDPY01000001.1 | PID64649.1 | GamCas7x3 |
| 31 | NCBI | NZ_JMLA01000001.1 | WP_027150709.1 | MetCas7x3 |
| 32 | NCBI | NZ_FOGH01000010.1 | WP_090332053.1 | NisCas7x3 |
| 359 | NCBI | MVRP01000104.1 | - | SybCas7-11 |

FIG. 27A

| SEQ ID NO | Cas7-11 effector annotation |
|---|---|
| 1 | TIGR03986 family CRISPR-associated RAMP protein [Candidatus Jettenia caeni] |
| 2 | RAMP superfamily protein [Candidatus Scalindua brodae] |
| 3 | hypothetical protein B6245_13290 [Desulfobacteraceae bacterium 4572_88] |
| 4 | protein containing DUF324 [Candidatus Magnetomorum sp. HK-1] |
| 5 | hypothetical protein [Desulfonema ishimotonii] |
| 6 | RAMP superfamily protein, partial [Candidatus Brocadia fulgida] |
| 7 | TIGR03986 family CRISPR-associated RAMP protein, partial [Deltaproteobacteria bacterium] |
| 8 | hypothetical protein A2511_12465 [Deltaproteobacteria bacterium RIFOXYD12_FULL_50_9] |
| 9 | TIGR03986 family CRISPR-associated RAMP protein, partial [Deltaproteobacteria bacterium] |
| 10 | RAMP superfamily protein [Syntrophorhabdaceae bacterium PtaU1.Bin034] |
| 11 | hypothetical protein DRI57_30415, partial [Deltaproteobacteria bacterium] |
| 12 | hypothetical protein DRI57_30410, partial [Deltaproteobacteria bacterium] |
| 13 | hypothetical protein A4E57_03052 [Syntrophorhabdaceae bacterium PtaU1.Bin034] |
| 14 | hypothetical protein D6778_09755, partial [Nitrospirae bacterium] |
| 15 | CRISPR/Cas system CMR subunit Cmr4 (Cas7 group RAMP superfamily) |
| 16 | CRISPR/Cas system CMR subunit Cmr4, Cas7 group, RAMP superfamily |
| 17 | cold shock CspA family protein/CRISPR/Cas system CMR subunit Cmr4 (Cas7 group RAMP superfamily) |
| 18 | Uncharacterized protein predicted to be involved in DNA repair (RAMP superfamily) |
| 19 | Cold shock proteins |
| 20 | None |
| 21 | None |
| 22 | None |
| 23 | None |
| 24 | None |
| 25 | None |
| 26 | None |
| 27 | None |
| 28 | None |
| 29 | None |
| 30 | None |
| 31 | None |
| 32 | None |
| 359 | None |

FIG. 27B

| SEQ ID NO | Organism/source | Length |
|---|---|---|
| 1 | Candidatus Jettenia caeni | 1812 |
| 2 | Candidatus Scalindua brodae | 1717 |
| 3 | Desulfobacteraceae bacterium 4572_88 | 1659 |
| 4 | Candidatus Magnetomorum sp. HK-1 | 1657 |
| 5 | Desulfonema ishimotonii | 1601 |
| 6 | Candidatus Brocadia fulgida | 1573 |
| 7 | Deltaproteobacteria bacterium | 1526 |
| 8 | Deltaproteobacteria bacterium RIFOXYD12_FULL_50_9 | 1403 |
| 9 | Deltaproteobacteria bacterium | 1367 |
| 10 | Syntrophorhabdaceae bacterium PtaU1.Bin034 | 1322 |
| 11 | Deltaproteobacteria bacterium | 476 |
| 12 | Deltaproteobacteria bacterium | 437 |
| 13 | Syntrophorhabdaceae bacterium PtaU1.Bin034 | 350 |
| 14 | Nitrospirae bacterium | 348 |
| 15 | Hydrothermal vent sediment bacterial communities from Southern Trench, Guaymas Basin, Mexico - 4870-07-3-4_MG | 1528 |
| 16 | Sorted cell/s from Southern Trench hydrothermal vent microbial mat, Guaymas Basin, Mexico - 6X_4868_18_01 | 1652 |
| 17 | Hydrothermal vent microbial mat bacterial communities from Southern Trench, Guaymas Basin, Mexico - 4869-18-0-1_MG | 1723 |
| 18 | Hydrothermal sediment microbial communities from Guaymas Basin, California, USA 4484. Combined assembly of Gp0115313 and Gp0146561 | 1548 |
| 19 | Hydrocarbon resource environments microbial communities from Canada and USA | 1720 |
| 20 | freshwater metagenome, University of Waterloo | 1610 |
| 21 | soil metagenome genome assembly | 1575 |
| 22 | groundwater metagenome genome assembly | 1237 |
| 23 | wastewater metagenome [species] | 1291 |
| 24 | oral metagenome | 1801 |
| 25 | Hydrothermal vent metagenome isolate SMAR3k101_15 | 1322 |
| 26 | Desulfobulbus sp. | 1225 |
| 27 | Gammaproteobacteria bacterium | 1234 |
| 28 | Desulfobulbus sp. | 1258 |
| 29 | Methylococcaceae bacterium | 1235 |
| 30 | Gammaproteobacteria bacterium | 1276 |
| 31 | Methylobacter tundripaludum | 1221 |
| 32 | Nitrosomonas sp Nm51 | 1444 |
| 359 | Syntrophorhabdaceae bacterium PtaU1.Bin034 A4E57_contig000104 | 1329 |

```
WmCas7x3         ---------------- -- ----------------------- ----------------------------
SER16298.1       ---------------- -- ----------------------- ----------------------------
GwCas7x3         ---------------- -- ----------------------- ----------------------------
PID64649.1       ---------------- -- ----------------------- ----------------------------
WP_031436019.1   ---------------- -- ----------------------- ----------------------------
HEB50754.1       ---------------- -- ----------------------- ----------------------------
HreCas7-11       -LPAGKPEG------- -- -----RESIWEK----------- -TPTGE--TLTLRQLLKSANVPGE----
CmaCas7-11       -LPKGKKGG------- -- -----RTSIWNK----------- -KVADD--FTLRDCIKNQKIPNE-----
HvmCas7-11       -LPKGKTDK------- -- -----DNSVWDKPLKKDILPSPRM PASEDDDTPTLRKVLKDEINGQED----
SmCas7x3         FLPPGRVNK------- -- -----DGRRVPHYVWDIP----- -LGKGD--TLRKRLEFLAASCEGDQA---
oral_meta        -LPMGSQGL------- -- -----GGRL-PHHLWDVP----- -LVSKDRETQTLRSCLEKIAAQCKSEQT-
DisCas7-11       -LPKDHDGK------- -D -----DHYIⓜⓘIG---------- -KKKKDENSVTIRQILTTSADTKELKNAG
DsbaCas7-11      -LPLNHEGK------- -E -----NHHLWD------------ -KAGGE--TIRTILKAAAEKEAVAN---
SstCas7-11       -LPLDHEGK------- -E -----NHHLWD------------ -IGEGK--SIRELLLEKAESLPSD----
CsbCas7-11       -LPDGKEER------- -DK -----GHHLWDI---------- -KVQGT--ALRTKLKELWQSNKDI----
CjcCas7-11       -LPKGINDK------- -- -----HHLWDR------------ -EVNGK--KLRNILEELWRLMNKRN---
CbfCas7-11       -LPKGKSEKTTEQIEVNKHYLWDEI -----SVRHILIEQWRRWQSKKDD -PEWWKFCDFLGECLYKEYKKLTS--
HvsCas7-11       -LPIGPEDD------- -- -----GHYLWDKI---------- -PVNDT--TLRIFLRNCFSQYKD-----
HsmCas7-11       -LPRGIEKK------- -G -----GHWLWDKL---------- -KVEGK--LRKKFKEIANNYKD------
FmCas7-11        -LPRGRLNK------- -- -----EGEITAHYLWDE------ -R-----TIQVLEDTIELSPARSIIYKNWISFCNQLGQKLYERAKD-
DpbaCas7-11      -VAEENHEK------- -- -----ASLLYKK----------- -TKKGD--SIAALIAGKTEGMDA-----
Domains
```

```
WmCas7x3         ---------------- -- ---------------------- -TGTDQRITPDAPDA----DPY
SER16298.1       ---------------- -- ---------------------- -TGLDEEMDKQSGESVDKKQNNS
GwCas7x3         ---------------- -- ---------------------- -TGLDE------KERDENKETR
PID64649.1       ---------------- -- ---------------------- -DG---GTIPVTIKDTQGKNREV
WP_031436019.1   ---------------- -- ---------------------- -SG---EFCEHDDVKNNDG--EPV
HEB50754.1       ---------------- -- ---------------------- -AS---ETVEHDLIKNDDG--TPV
HreCas7-11       FYGQPARKS------- -- --DDPMIRASYR---------- -AFPS---YVWVLDGILRAETPFYFG-----TET-----SEGQTS
CmaCas7-11       YAGLPLRKE------- -- --DEKEYSPTYQN--------- -QESLPK--TKWIISGELQAITPFYIG-----HVN-----KTSHTR
HvmCas7-11       IYGLPMREN------- -- --KEDEPLPSSLT--------- -YK-----FKWLIAGELRAETPFFFG-----TEV-----QEGQTS
SmCas7x3         QVRPPQPPV------- -- --SYSEESINSDL--------- -PL-----AEWIITGTLRAETPFAIGM----DAPI----DDDQTS
oral_meta        PCLDPSKTI------- -- --RTKGPVPGKQK--------- -HRFSLLPPFEWIITGTLKAQTPFFIP---DEQG----SHDHTS
DisCas7-11       FHGKPDRI Ⓜ ------ -- --KSRSVSIGSVL--------- -------KETIMGTLKAETPFFFG------AⓁE----DAKQTⓄ
DsbaCas7-11      FSDKSVPDT------- -- --VSHSIGISVE---------- -------KETILCGKLISETPFFFG------IESK----EKKQTD
SstCas7-11       FWSKADRQL------- -- --NPSAVSIPVT---------- -------TETLICGKLISETPFFFG------TEIE----DAKHTN
CsbCas7-11       YYSKAHDSE------- -- --GSDLFIPVTPP--------- -EGIET--KEWIIVGRLKAATPFYFGVQQPSDSIPGKEK--KSEDSLV
CjcCas7-11       YYPEPEKTEPCLISDNSIPITPL---------- -GGV----KEWIIIGRLKAETPFYFGVGVQSSFDSTQDDLDLVPDIVNTDEKLE-ANEQTS
CbfCas7-11       YYGALGMPD------- -- --KVIPLLKSDKT--------- -------KEWILVGSLKAETPFFGLET-----EQTE----EVEHTS
HvsCas7-11       HFAEKKDPQ------- -- --ISPIYIDKDDK--------- -V-----YEWIIVGRLIAQTPFHFG-----------------DEEKAE
HsmCas7-11       YRKIPEQEI------- -- --SFLPSKAGYS---------- -------YEWIILGKLISENPFFFG------KETK----TEEQID
FmCas7-11        FSKVPTSSH------- -- --APRHDMNSRVK--------- -GGFT---REWIIVGTLRALTPFYMG-----TGSQ----AGKQTS
DpbaCas7-11      RYSLQKKPT------- -- --VRTDLAAELVP--------- -D-----IEFIIKGNLIAETPFFFG------TDIA----TETHTD
Domains
```

```
WmCas7x3        VAQG--------HAVPPVKNNTCP-DPATI------LFGTAGWRGLLRTDD----------------------------------------------CTGTA-
SER16298.1      IPQG--------HAAPAYDGIAHR-DLISL------LFGTAGWKGIVCASDLIHSIPEYALQFNGVRETISDLSDTVKSCIIVDLVKTSTAAEKTEEQLHIRIV
GwCas7x3        TPQG--------HTAPAYRKGQPHDDLAVL------LFGAAGWRGIVQTSD-------------------------------------------CIVED-
PID64649.1      CCDG--------SINNTCK---------NPKNLCIACEMFGSTGWKTSIEMDPFL--------------------------------------CVDRE-
WP_031436019.1  CCS---------TDDPCKPIFDKGDLSKLCLACQIFGASGWKTVINIHDFK------------------------------------------AINKS-
HEB50754.1      CCD---------TSSPCRPLGSSDKVGELCLACQVFGAPGWGTTLHIQGFT------------------------------------------CTSV--
HreCas7-11      -DAPNE------NGLTYFE--ADHEE--CDCLLCSLFGSKHYQGKLRFEDAE-----------------------------------------LQDEV-
CmaCas7-11      -EIKLE------DGKKERIFN--LDHED--CDCILCRLFGNVHQQGILRFEDAE---------------------------------------ITNKN-
HvmCas7-11      ------------NEELYD--TDHED--CDCLLCRLFGSIHQQGSLRFEDAE------------------------------------------VQNSV-
SmCas7x3        ------------AGDDLLT--RSHQD--CKCEICQLFGSEHRAGILRFEDLP-----------------------------------------PVSPT-
oral_meta       ------------YGISLIN--DEHED--CDCPLCKIFGNEHHAGMLRFDDMV-----------------------------------------PVGTW-
DisCas7-11      -HME--------DGVPLTE--LTHSD--CECILCQIFGSEYEAGKIRFE*LV-----------------------------------------FES*P-
DsbaCas7-11     -NQGNDDIT---GKKNVPLIA--LTHQD--CECMLCRFFGSEYEAGRLYFEDLT---------------------------------------FESEP-
SstCas7-11      -HFDKEGKPLDKEGKPLLT--LIHQD--CECLICRLFGSEHETGRLRFEDLL-----------------------------------------FDPQP-
CsbCas7-11      ------------TGDLG-K--EDHED--CTCDMCIIFGNEHESSKIRFEDLE-----------------------------------------LINGN-
CjcCas7-11      ------------SGDLG-M--DDHED--CSCTILCTIFGNEHEHEAGKLRFEDLE-------------------------------------- VVEEK-
CbfCas7-11      ------------KNVLT---KNHED--CTCSLCAIFGNENETGKIRFEDLE------------------------------------------VYDKD-
HvsCas7-11      ------------NNLLA-K--NDHDD--CICVLCHLFGNVHETGRLKFEDLK-----------------------------------------IVSGQ-
HsmCas7-11      ------------EGKLTTE--NEHED--CTCILCRLFGNEHETGKVRFEDLE-----------------------------------------LINDS-
FmCas7-11       ------------DALLI---KSHED--CDCLLCEAFGSKHHEGKLRFEDLT------------------------------------------PKSDE-
DpbaCas7-11     ------------KNLSS---NLHED--CECLRCKIFGSKHQEGNIRFEDMT------------------------------------------VSQES-
Domains WmCas7x3        ------------------------------------------------------------------PAT------LVD
SER16298.1      DSAGSLIVHKSENSSWANDTFFRDASVKDNFKARLKEIADPQDLSDALRADIKKRAFQLAT------LTR
GwCas7x3        -------------------------------------------------------KSIK-------TRR
PID64649.1      -------------------------------------------------------LKP--------FII
WP_031436019.1  -------------------------------------------------------K----------KTK
HEB50754.1      -------------------------------------------------------FRR--------EQE
HreCas7-11      -------------------------------------------------------EA---------IK
CmaCas7-11      -------------------------------------------------------K----------DCC
HvmCas7-11      -------------------------------------------------------VS---------KK
SmCas7x3        -------------------------------------------------------SD---------ADKR
oral_meta       -------------------------------------------------------TV---------KK
DisCas7-11      -------------------------------------------------------ND---------VT
DsbaCas7-11     -------------------------------------------------------EP---------RR
SstCas7-11      -------------------------------------------------------EP---------MI
CsbCas7-11      -------------------------------------------------------EF---------EKLEKH
CjcCas7-11      -------------------------------------------------------LPSEQNSDSNKIPFGPVQDGDGNREKECVTAVKSYKKKL--KK
CbfCas7-11      -------------------------------------------------------IA---------KF
HvsCas7-11      -------------------------------------------------------EE---------KR
HsmCas7-11      -------------------------------------------------------AP---------TYR
FmCas7-11       -------------------------------------------------------IK---------REKL
DpbaCas7-11     -------------------------------------------------------EV---------
Domains
```

```
WmCas7x3        QLFI--PDFVE--TPAA--DDL-----------------------LPIP-QGV-LDTFHALADLALAGQH-------W-GKDE-TPADD-QLLPFTPAGRQR
SER16298.1      HVFL--PDTTKRVSP--------------------------------LEIP-PHV-KKRFHELADLALAGLH-------L-KQGE-TIASPYKILPYTPIGRNK
GwCas7x3        HVFL--PDVFIDAPPPV--NDL-------------------------YPIP-DSV-IQRFHDLADQVLASMN-------L-KPEE-IVDST-NLLPYTPVGRRS
PID64649.1      ELFI--PVFDAFVADPK--TFLD---------------------TATAFLIP-RNV-IDAFEKIAEKQTQSQKQDK-L-KHDE-------ERLPFHLKGTRR
WP_031436019.1  ELFI--PVPLEYVDTEN--NKFDYQAYKK---------A-----FLYRAIEIP-EPV-LKRYSELADQRTMSQKSNKEL-KKDD-TCQSV-GWLPFHLKGTKR
HEB50754.1      EYFI--EIPERYVD--QD--HCFDYRMFIR-----D--------RARNGTLVPISFVAWERYHCLAEERTLSQKNDPEL-REDK-ACASL-KWLPFHPKGRVR
HreCas7-11      CYPR--PLLVC--------IK--DKAEYRIHKRCEAIFCSI----GSPSDLYDIP-QKV-SNQYRTIL-------QDYNDNTGK--IVE-IF----------RTQ
CmaCas7-11      KYPR--PVFIC--------KK--NGVEYRMQKRCERIFDFT----KEEEKDKEIVIP-QKV-VSQYNAIL-------KDNKENTET--IPG-LF----------NSK
HvmCas7-11      EYPR--PVLKC--------VK--DGTEYVMLKRSEHVFAEA----SSEDSYPVP-GKV-RKQFNSIS-------RDNVQNTDH--LSS-MF----------QSR
SmCas7x3        EYPR--PGFTC--------VI--DGKEYSLTKRCERIFEDI----SGGENQVVRAVT-ERV-REQYREIL-------ASYRANAAG--IAE-GF----------RTR
oral_meta       EYPR--PSFTC--------TV--DGKQYTVNKRCERVFEDS----AAPAIELP-RMV-REGYKGIL-------TDYEQNAKH--IPQ-GF----------QTR
DisCas7-11      ------PVFCC--------ED--DKGNYTMAKYCETFFFDL----KENEYEIP-EKA-RIKYKELL-------RVYNNNPQA--VPESVF---------QSR
DsbaCas7-11     KRKRLVPEYVC--------ADPEKKVTVTMKRCERIFLEK-----SRRIIPFT-NDA-VDKFELLV-------KEYRRNAEQQDTPE-AF---------QTL
ErdRLVGEFAC----YDPEKKVTYSMTKRCERIFIKD------RGRTLPIT-HEA-SELFEILV-------QEYRENAKRQDTPE-VF---------QTL
-YPR--PRLLF--------TK--DQYEYNITKRCERVFEID----KGNKTGYPVD-DQI-KKNYEDIL-------DSYDGIKDQ-EVAE-RF---------DTF
GYPR--PVLKF--------IK--DRVEYTIPKRCERIFCIP----VKNTIEYKVS-SKV-CKQYKDVL-------SDYEKNFGH--INK-IF---------TTK
EYPR--PALHF--------NH--DGKEYTIPKRCERVFVRAEAAGKRAETEGSYKVP-RKV-QEQYQNIL-------RDYESNIGH--IDN-TF---------RTI
ERPRNIPCFVC--------SD--KEKIYRMTKRCERVFVSL----GENAPKYEIP-ISA-IRRYKRT-------SAYRENWERNKTPE-LF---------RTL
QRRRNVPAFCC--------YDYNTNRCFVMNKRCERVFKVS----RDKPKYEIP-PDA-IRRYEHVL-------RKYRENWERYDIPE-VF---------RTR
------VYRC---------QL--KGVTYTVAKWCEAFWVKD----EGKKPITVN-AEA-INRYHLIM-------KSYQDNPQS--PPI-IF---------RSL
------KFIC---------QY--GTTTYTVDKWCEAFFCDE----EKDPYELA-PDV-ERKYRLLM-------DSYHNNPQA--PPQ-IF---------RSL
Domains         ▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓

WmCas7x3        ----HDA---DRPPRDADRQRTRLQPGDLIVCFD---LG--------DGAVSEISFSSIWREGLRLAG--KPN-LATTADLLAQ-------V
SER16298.1      ----LENHIHRVPNDLITCYMTRLKKGDLIVFFD---VD--------N--DGQITEISFSSIWRAGI----GTKNK-LQTTADLLSQ------R
GwCas7x3        ----DSD---CRDTRLQAGDLIFFD---------IDPPLHPG-E---KSQITEISFSSIWRSGI--G-KDH-LLTTPDLLTN------F
PID64649.1      ----EQN---HTLQIKTGDLIVFK---PN--A-K-------GDEVEEIAFSSIWRGKT-----------SGTTADFFPD--------K
WP_031436019.1  ----QLD---DKHNVGKLQIDEYDLIYYE--AS--------------GKEVTEVAFSSIWRGRV-----ETNSS-QANKVYSFIP-----G
HEB50754.1      ----ERD---PENDVCHLSLRHGDLIVFYA--EQ-------------NRVVSEISFSAIWRSRV-----ETSDSYQAVTVDCFVP----K
HreCas7-11      ----IKH---DQ--LTTGDLIVFK---PA-----A------------NGQVNAVIPVSISRKTD-------ENPLAKRFKN--------D
CmaCas7-11      ----MVN---KE--LEDGDLIVFK---YK------------------EGKVTELTPVAISRKTD--------NKPMGKRFPKISINGKMKPND
HvmCas7-11      ----RLH---DE--LSHGDLIVFK---HD--------E---------KRKVTDIAYVRVSRKTD--------DRPMGKRFKN---------E
SmCas7x3        ----MYD---TE--ELRENDLIVFKTAKQ------ADG---------KERVVAISPVCISREAD--------DRPLGKRLP----------A
oral_meta       ----FSS---YR-ELNDGDLIVYK---TD--------S---------QGRVTDLAPVCLSRLAD--------DRPLGKRLP----------E
DisCas7-11      ----VARE--NVEKLKSC■LIVFK---HN------------------EKYVEDIVFPVRISRTVD--------DRMIGKRMS----------A
DsbaCas7-11     ----LPE---NG-TVNPGDLLYFR---EE------------------KGKAAEIVPVRISRKVD--------DRHIGKRID----------P
SstCas7-11      ----LPD---NG-RLNPGDLLYFR---EE------------------KGKTVEIIPVRISRKID--------DSPIGKRLR----------E
CsbCas7-11      ----TRG---SK--LKVGDLIVFH---ID------G-----------DNKIDSLIPVRISRKCA--------SKTLGGKLD----------K
CjcCas7-11      ----IQK---RE--LTTGDLIVFI---PN-----EGA----------DKTVQAIMPVPLSRITD--------SRTLGERLPH---------K
CbfCas7-11      ----IEN---CG--LNNGSLIVFR---PD-----N-S----------RREVVAITPVKISRKTD--------RLPQGDRFPHTS--------S
HvsCas7-11      ----LPG---DGRTLNEEDLIVYFR--LD-----E------------NEKVKDIIPVCISRIVD--------EVPLIKRLS----------Q
HsmCas7-11      ----LPG---DGETLNEGDLIVYFR--LD------------------NNRVLDIIPVSISRISD--------TQYLGRRLP----------D
FmCas7-11       PVLNYKQ---DQKII--GSMIFYR---ES------------AKS---DKIVNEIIPVKISRTAD--------TELLAKHLPN---------N
DpbaCas7-11     PLFSETG---PKKTILEHGDLIVFRLSEV------------------NKQSQSKKQVRERVTDIVPVSISRIAN-----NQPIGKHIA------A
Domains         ▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓▓
```

```
WmCas7x3         QG----QVARLDNSGHVPSDGSGRPPW------QSRFDG---------QEDSGNK----RRVRVEPIPAGETFHFEIDFDNLSPTELEQLCATLLP-HPAFEH
SER16298.1       QNG---NVMKLDAIGVNSGGSTCKPPWKTHKPAANDQKE---------FEEDKNKFITSRQVKIAPISENTPFYFEIDFNNLDATELAQLCATLQP-APKFEH
GwCas7x3         NE----QVVELSDTGH---DGGVRPPW-------------VSKFDE---------SADEGNK----RRVSIEPIAKDESFYFEVDFHNLSRTELAQLCATLYP-NEKFEH
PID64649.1       ENN-QNVQRITSQGKFDNAANRTQPW--------------VS--------QNEERNH----LKTKCKPLKSGLNFFFHIDFNNLITQWELGLLCYALRP-CETFRH
WP_031436019.1   GDN--KVQKLGSQGETANGGDSKLPW--------------LKVKIPIKAE--FIFSLDFNNLTEWELGLLCYALRP-TDSFRH
HEB50754.1       RGNPDRVQSLDRYGH-ATETAANPPW--------------ETC-------NPDERPQ----IKVRVQPVRRKTKFFHLDFSNLSRWELGLLCYVLRP-TACFRH
HreCas7-11       ----D------GI--------------------------------------HPEERPQ----NNRTIEPLAEGNEFVFDIDFENLRDWELGLLLYSLEL-EDSLAH
CmaCas7-11       ENI-K------NNQGN-----------------------QKDISLKPDSDAIKIKE------NNRTIEPLGKDNVFNFEISFNNLRDWELGLLLYAIEL-EDHLAH
HvmCas7-11       DKI-R------NRQFD-----------------------PAK-EKQPD-DVIKPNE------NNRTVEPLGKGNEFTFEVRFNNLREWELGLLLYSLEL-EDNMAH
SmCas7x3         -VM-A------GTNPI----------------TG--------ESIEKTA----NNATVEAIMPGATFTFDIVCENLDQQELGLLLYSLEL-EEGMSH
oral_meta        MWG-D------DDKPD----------------SRPSSEE---CQDIIEGIGPGEKFHFRVAFENLDKNELGRLLYSLEL-DAGMNH
DisCas7-11       -IK-D------GNHPT----------------TG--------KAIEQSP---NNRTVEALAGGNSFSFEIAFENLKEWELGLLIHSLQL-EKGLAH
DsbaCas7-11      -IS-E------GIHPI----------------SG--------ENIEPDE---NNRTVEVLDKGNRFVFELSFENLEPRELGLLIHSLQL-EKGLAH
SstCas7-11       -IN-C------GCHPT----------------TK--------ENIVQNQ---NNRTVEPLDKGNTFSFEICFENLEPYELGLLIYTLEL-EKGLAH
CsbCas7-11       -IR-Q------KQLEI-----------------------RETVQPE----RNVTTEVMDKGNVFSFDVRFENLREWELGLLQSLDP-GKNIAH
CjcCas7-11       -VL-R------NN------------------------DITPKTE-----NNRTVEPLAADNRFTFDVYFENLREWELGLLHCLEL-EPGMGH
CbfCas7-11       -VK-K------NQ------------------------RTLVKTE-----NNRTVKALDKENEFTFEVFFENLENWELGLLHCLEL-EPEMGH
HvsCas7-11       IIN-N------SKK-----------------EKEKKEK----NNASFEVLKEG-EFTFKVYFENLENLEWELGLLLLSLT--GLGEAI
IYKCas7-11       IYK-K------NKK-----------------NEIKKEK----NNATFEVIKQG-TFYFKVFFENLELMEWELGLLIIFSAELGGEEFAH
FmCas7-11        IVD-E------GKNPI---------NG----DVIEPDA---NNRTVEPLAAGNDFSFEVFFENLRGWELGLLRYTLEL-ESELAH
DpbaCas7-11      -VQ-E------GKNPI---------DQ----KAIRPNP----NNSSVEVLNLGNEFQFEVSFENLEEWELGLLLYCLEL-EPGLAH
Domains
                 G-rich loop
WmCas7x3         RLGMGKPIGLGSVKLAVEGL---LLVDRPRRYAEDEPNAPRHHRGW--RAN--ADAG--WPDHLQGDSPAAPLEAT-EQP-AALAERAMA
SER16298.1       RLGMGKPLGLGSVKIEPVGL---FLINRHQRYTTDSTNCDRYHYAW--LKG--EHAAWDWPEYFRQNVTADCTQIFNDTFDKLVQNGLA
GwCas7x3         RLGMGKPLGLGSIKITPLSL---FLVNRSQRYATDGLDKPRYHAVM--HTG--TASEPRWPDHLQREQQGIAFEGVSTAP-TVMSLAAEA
PID64649.1       KIGMGRPIGLGTVKIDIAVL---QTIDRYARYTDTTQDSERYNQGA--WIS--QELQNEIPN--QYKGKGISNKKGMLSP-EDCRKVFME
WP_031436019.1   RIGMGKPLGLGSVKIDIMAL---QTINRQQRYAQDGLEENRFNRHN--WVN--PPHQPRL----EKAGYSISLSSTPLNP-EILRATFTK
HEB50754.1       KLGMGKPLGLGSVRIDIASL---QLIDRVRRYGTDDLTAGRYNMGG--HFN--ASCLDLLP---QDSPAPDDSGAAPDP-GTLRQDFVK--
HreCas7-11       KLGLGKPLSFGTVQINIRGI---SLKN---------GSKG--WDTKTGDDKNQWIK-----KGF------------AHLGIDIKE----
CmaCas7-11       KLGMAKAFGCMGSVKIEIKNL---LIKG---------SIND---ISKAELIK------KGF------------KKLGIDSLEKD----
HvmCas7-11       KLGMGRALLGMGSARIKAEAI---ELRC---------ESA---GQNAELKDKAAFVR----KGF------------EFLEIDKPGEN----
SmCas7x3         TLGRGKPLLGFCNVRIKVEKI---EKRL---------SDG---------SRREMIPP-----KGA------------GLFMTDKVQDALRGLTEG
oral_meta        HLGHGKAFGFGQVKIRVTKL---ERRL---------EPGQ---WRS---EKICTDLPV-----TSS------------ELVISSLKK----
DisCas7-11       KLGMATSMGFGSVEIDVESV---RLRK---------DWKQ---WRN-GNSEIPNWLG-----KGF------------AKLKEWFRD----
DsbaCas7-11      KLGDAKSMGEGSVEIDVESV---RVKH---------RSGE---WDYKDGETVDGWIE-----EGK------------RGVAARGKA----
SstCas7-11       KLGMARLMGFGSIDIEVENV---SLRT---------DSGQ---WKD-ANEQISEWTD-----KGK------------KDAGKWFKT----
CsbCas7-11       KLGKGKPIYGFGSVKIKIDSLHTFKINS--------NNDK---IKRVPQSDIREYIN-----KGY------------QKLIEWSGNNSIQKGNVL
CjcCas7-11       KLGMGKPMGEGSSVKIAIERLQTFTVHQ--------DGIN---WKP-SENEIGVYVQ-----KGR------------EKLVEWFTPSAPHKNM--
CbfCas7-11       KLGMGKRFIGFGSVKIRIDKLQKCVNNV--------KDGCVLWEP-EEDKIQHYIA-----KGL------------GKLITWFGK----
HvsCas7-11       KIGHAKPLGFGSVKIEAAKI---YFRE---------EAGK---FHP-CEKADEYLK-----KGL------------NKLTSWFGK----
HsmCas7-11       KLGHGKALLGFGSVKISVDKI---ILRR---------DPGQ---FEQRGQKFKRDAVD----KGF------------CVLENRFGK----
FmCas7-11        KLGMGKAFGFGSVKIKIKSV---DLRK---------QGE---------WEK--ATN-------------TLVSEDKKS----
DpbaCas7-11      KLGRGKAFGEGSIEAEVSKI---EMRI---------KSGT---WKNE-TSGKEKFIQ----SGL------------SQVPSFFKQDEK----
Domains
```

```
WmCas7x3           --------------------------------
SER16298.1         --------------------------------
GwCas7x3           --------------------------------
PID64649.1         --------------------------------
WP_031436019.1     --------------------------------
HEB50754.1         --------------------------------
HreCas7-11         EEIFVHRSGVADNSIPKEGQKVGFRIERGARGSHAVEVKAIE----
CmaCas7-11         --------------------------------
HvmCas7-11         KDVFVHHSSIVGTGFKSLNEGDSVAFKMGVGPKGPCAEKVKKIGN
SmCas7x3           --------------------------------
oral_meta          RDIFVHFSAIRGEGYKILEPGEKVRFEIGEGRKGPQAINVIRIR--
DisCas7-11         --------------------------------
DsbaCas7-11        --------------------------------
SstCas7-11         --------------------------------
CsbCas7-11         --------------------------------
CjcCas7-11         KEVSISKNSIRGNILLKKGQKVTFHIVQGLIPKAEDIEIAK-----
CbfCas7-11         --------------------------------
HvsCas7-11         --------------------------------
HsmCas7-11         --------------------------------
FmCas7-11          NIHFAGNQICRPET--SLQSGDKVKFIEGENYKGPTALKVERLKG
DpbaCas7-11        --------------------------------
Domains            ..............................................
```

FIG. 340

SYSTEMS, METHODS, AND COMPOSITIONS FOR RNA-GUIDED RNA-TARGETING CRISPR EFFECTORS

RELATED APPLICATIONS

This application claims priority to U.S. Provisional Application Nos. 63/073,898 filed Sep. 2, 2020 and 63/208,606, filed Jun. 9, 2021, the entire contents of which are hereby incorporated by reference in their entirety.

STATEMENT REGARDING FEDERALLY SPONSORED RESEARCH OR DEVELOPMENT

This invention was made with government support under Grant No. R21 AI149694 awarded by the National Institutes of Health (NIH). The government has certain rights in the invention.

SEQUENCE LISTING

The instant application contains a Sequence Listing which has been submitted electronically in ASCII format and is hereby incorporated by reference in its entirety. Said ASCII copy, created on Dec. 7, 2022, is named 719269_083474-015 SL.txt and is 912,373 bytes in size.

TECHNOLOGY FIELD

The subject matter disclosed herein is generally related to systems, methods, and compositions for RNA-guided RNA-targeting CRISPR effectors for the treatment of diseases and diagnostics.

BACKGROUND

RNA targeting tools for genetic engineering are important to study RNA biology and develop RNA therapeutics. These tools can regulate intracellular and intercellular target-gene functions and expressions and manipulate specific target-genomic information. In contrast to DNA targeting tools, only a few RNA targeting tools for CRISPR applications have been developed, and these RNA specific tools present challenges. For instance, protein complexes for CRISPR RNA editing can have a weak activity in mammalian cells and present collateral effects which can be toxic in some cell types. Also, the size of the RNA editing tools can be a significant barrier to their use, as technologies such as programmable activation cannot be delivered in mouse models using common methods such as adeno-associated vectors (AAV). Development of effective gene and cell therapies requires genome editing tools and delivery technologies that can meet the demands for cell type specificity, large payload sizes, and efficient integration of diverse and large sequences. Many applications, including single-vector homology directed repair (HDR), CRISPR base editing, gene activation, and large gene delivery, are limited by AAV size restrictions. Thus, there remains a need for more effective tools for gene correction and delivery.

SUMMARY

The present invention is directed to systems, methods, and compositions for RNA-guided RNA-targeting CRISPR effectors for the treatment of diseases and diagnostics. It also pertains to nucleotide deaminase functionalized CRISPR systems for RNA editing RNA knockdown, viral resistance, splicing modulation, RNA tracking, translation modulation, and epi-transcriptomic modifications.

In one aspect, a composition that cleaves an RNA target is discussed, which comprises a guide RNA that specifically hybridizes to the RNA target, and a polypeptide comprising an amino acid sequence 85% identical to an amino acid sequence selected from the group consisting of SEQ ID NOs: 1-32 and 632. The amino acid sequence can be SEQ ID NO: 1. The polypeptide can comprise a glutamate at a position corresponding to position 70 of SEQ ID NO:1, an aspartate at a position corresponding to position 429 of SEQ ID NO:1, an aspartate at a position corresponding to position 487 of SEQ ID NO:1, and/or an aspartate at a position corresponding to position 654 of SEQ ID NO:1. If desired, the polypeptide can comprise an amino acid sequence 90% identical to the amino acid sequence of SEQ ID NO:1. If desired, the polypeptide can comprise an amino acid sequence 95% identical to the amino acid sequence of SEQ ID NO:1. If desired, the polypeptide can comprise an amino acid sequence 99% identical to the amino acid sequence of SEQ ID NO:1. If desired, the polypeptide can be the amino acid sequence of SEQ ID NO:1.

Yet in another aspect, the guide RNA comprises a mismatch distance that is 20-65% of the length of the guide. If desired, the guide RNA can comprise a mismatch that is about 20 to about 30 nucleotides from the non-pairing C of the guide RNA. If desired, the guide RNA can have a sequence with a length of from about 20 to about 53 nucleotides (nt), preferably from about 25 to about 53 nt, more preferably from about 29 to about 53 nt or from about 40 to about 50 nt. If desired, the guide RNA can be a pre-crRNA. If desired, the guide RNA can be a mature crRNA.

Yet in another aspect, the RNA target can be a single-strand RNA (ssRNA). If desired, the RNA target can be in a cell. The cell can be a prokaryotic cell. The cell can be a eukaryotic cell. The eukaryotic cell can be a mammalian cell. The mammalian cell can be a human cell.

Yet in another aspect, the polypeptide can comprise a deaminase domain. The deaminase can be selected from the group consisting of an adenosine deaminase, a cytidine deaminase, and a catalytic domain thereof. If desired, the deaminase can be an adenosine deaminase. If desired, the deaminase domain can comprise an amino acid sequence 85% identical to an amino acid sequence selected from the group consisting of SEQ ID NOs: 25-31. If desired, the deaminase domain can comprise an amino acid sequence 85% identical to an amino acid sequence selected from the group consisting of SEQ ID NOs: 32-42.

Yet in another aspect, a nucleic acid molecule encoding the polypeptide is discussed. The nucleic acid molecule can encode the guide RNA.

Yet in another aspect, a vector comprising the nucleic acid molecule is discussed.

Yet in another aspect, a cell comprising the composition, the nucleic acid molecule or the vector is discussed. If desired, the cell can be a prokaryotic cell. If desired, the cell can be a eukaryotic cell. The eukaryotic cell can be a mammalian cell. The mammalian cell can be a human cell.

Yet in another aspect, a method of cleaving an RNA target in a cell is discussed, which comprises providing to the cell the composition, the nucleic acid molecule or the vector. If desired, the RNA target can be an ssRNA.

Yet in another aspect, a method of stabilizing an RNA target in a cell is discussed, which comprises providing to the cell the composition, the nucleic acid molecule or the vector. If desired, the RNA target can be an ssRNA.

Yet in another aspect, a method of affecting translation of an RNA target in a cell is discussed, which comprises providing to the cell the composition, the nucleic acid molecule or the vector. If desired, the RNA target can be an ssRNA.

Yet in another aspect, a method of treating a genetically inherited disease in a subject in need thereof is discussed, which comprises administering to the subject an effective amount of the composition, the nucleic acid molecule or the vector, wherein the genetically inherited disease involves a guanosine to adenosine change in the genome of the subject. The genetically inherited disease can be selected from the group consisting of Meier-Gorlin syndrome; Seckel syndrome 4; Joubert syndrome 5; Leber congenital amaurosis 10; Charcot-Marie-Tooth disease, type 2; leukoencephalopathy; Usher syndrome, type 2C; spinocerebellar ataxia 28; glycogen storage disease type III; primary hyperoxaluria, type I; long QT syndrome 2; Sjogren-Larsson syndrome; hereditary fructosuria; neuroblastoma; amyotrophic lateral sclerosis type 9; Kallmann syndrome 1; limb-girdle muscular dystrophy, type 2L; familial adenomatous polyposis 1; familial type 3 hyperlipoproteinemia; Alzheimer's disease, type 1; metachromatic leukodystrophy; and cancer.

Yet in another aspect, a method of treating a genetically inherited disease in a subject in need thereof is discussed, which comprises administering to the subject an effective amount of the composition, the nucleic acid molecule or the vector, wherein the genetically inherited disease is a pre-termination disease.

Yet in another aspect, a method of altering splicing of a pre-mRNA in a cell is discussed, which comprises administering to the cell an effective amount of the composition, the nucleic acid molecule or the vector.

Yet in another aspect, a method of changing microRNA targets in a subject in need is discussed, which comprises administering to the subject an effective amount of the composition, the nucleic acid molecule or the vector.

Yet in another aspect, a method of increasing RNA stability in a cell is discussed, which comprises administering to the cell an effective amount of the composition, the nucleic acid molecule or the vector.

Yet in another aspect, a method of modulating translation in a cell is discussed, which comprises administering to the cell an effective amount of the composition, the nucleic acid molecule or the vector.

Yet in another aspect, a method of detecting a bacterium or derivative thereof in a sample is discussed, the method comprises adding to the sample an effective amount of the composition, the nucleic acid molecule or the vector, and detecting a reporter specific to the bacterium or derivative thereof.

Yet in another aspect, a method of detecting a virus or derivative thereof in a sample is discussed, the method comprises adding to the sample an effective amount of the composition, the nucleic acid molecule or the vector, and detecting a reporter specific to the virus or derivative thereof.

These and other aspects of the applicants' teaching are set forth herein.

BRIEF DESCRIPTION OF THE DRAWINGS

Aspects, features, benefits and advantages of the embodiments described herein will be apparent with regard to the following description, appended claims, and accompanying drawings where:

FIG. 1C illustrates the comparison of Cas7-11 features to characteristics of Cas13 and type III-A/B/C systems according to embodiments of the present teachings;

FIG. 1D illustrates hypothetical scenario for the evolution of a single-protein CRISPR-Cas effector from a multi-subunit effector complex according to embodiments of the present teachings;

FIG. 1F illustrates multiple alignments of representative Cas7-11 orthologs showing conservation of the residues involved in catalysis (D177) according to embodiments of the present teachings. Figure discloses SEQ ID NOS 451-475, respectively, in order of appearance;

FIG. 1G illustrates multiple alignments of representative Cas7-11 orthologs showing conservation of the residues involved in catalysis (D429) according to embodiments of the present teachings. Figure discloses SEQ ID NOS 476-502, respectively, in order of appearance;

FIG. 1H illustrates multiple alignments of representative Cas7-11 orthologs showing conservation of the residues involved in catalysis (D654) according to embodiments of the present teachings. Figure discloses SEQ ID NOS 503-529, respectively, in order of appearance;

FIG. 1I illustrates multiple alignments of representative Cas7-11 orthologs showing conservation of the residues involved in catalysis (D745, D758) according to embodiments of the present teachings. Figure discloses SEQ ID NOS 530-556, respectively, in order of appearance;

FIG. 1J illustrates multiple alignments of representative Cas7-11 orthologs showing conservation of the residues involved in catalysis (E959) according to embodiments of the present teachings. Figure discloses SEQ ID NOS 557-583, respectively, in order of appearance;

FIG. 1K illustrates multiple alignments of representative Cas7-11 orthologs showing conservation of the residues involved in catalysis (E998) according to embodiments of the present teachings. Figure discloses SEQ ID NOS 584-610, respectively, in order of appearance;

FIG. 3I is a diagram of the DisCas7-11-mediate RFP knockdown by multiple targeting spacers normalized to a non-targeting condition as determined by flow cytometry according to embodiments of the present teachings;

FIG. 3J is a schematic of the DisCas7-11a full locus with TPR-CHAT nearby and DisCas7-11a effector expressed alone with TPR-CHAT according to embodiments of the present teachings;

FIG. 8AA is a graph showing the ribosomal RNA integrity analysis measured by BioAnalyzer traces in U87 cells treated with DisCas7-11, shRNA, LwaCas13a, and PspCas13b targeting Gluc transcripts for knockdown (the normalized area under the curves for the 18S and 28S bands) according to embodiments of the present teachings;

FIG. 8AB are graph showing the comparison of DisCas7-11 and RfCas13d knockdown activity across multiple guides in HepG2 cells along with data on collateral activity as measured by Cluc levels, cell health (live stain), and cell toxicity (dead stain), wherein data are mean (n=3)±s.e.m according to embodiments of the present teachings;

FIG. 8AC is a graph showing the collateral activity in mouse embryonic stem cells as measured by Cluc levels during Gluc RNA knockdown by DisCas7-11, HvsCas7-11, PspCas13b, and RfxCas13d, wherein the asterisks indicate significant as measured by a Student's t-test between the targeting and non-targeting conditions of a listed ortholog condition (**, p-value <0.01), and wherein data are mean (n=3)±s.e.m according to embodiments of the present teachings;

FIG. 11A illustrates the Type III-E locus of the *Desulfonema ishimotonii* according to embodiments of the present teachings;

FIG. 11B is a diagram showing the phage plaque assay of the Type III-E DisCas7-11 CRISPR-Cas locus according to embodiments of the present teachings;

FIG. 12D is an image of the processing of transcribed pre-crRNA showing the effect of consecutive double mutations on processing according to embodiments of the present teachings;

FIG. 13B is a schematic of in vitro cleavage of ssRNA target with DisCas7-11 and crRNA 5 according to embodiments of the present teachings;

FIG. 13C illustrates the incubation of ssRNA target with DisCas7-11 and targeting or non-targeting crRNA in the presence of different ions or chelating agents according to embodiments of the present teachings;

FIG. 14A is a schematic showing sequence of DisCas7-11 crRNA 5, targeting the ssRNA target according to embodiments of the present teachings. Figure discloses SEQ ID NO: 642;

FIG. 14B illustrates the cleavage of ssRNA target with crRNA of varying DR and spacer lengths according to embodiments of the present teachings;

FIG. 18E illustrates DisCas7-11a incubated with a crRNA targeting a crRNA site flanked by different sequences according to embodiments of the present teachings;

FIG. 18F illustrates DisCas7-11a incubated with a crRNA targeting a double-stranded (dsDNA) target with 5' labeling of the bottom strand according to embodiments of the present teachings;

FIG. 18G illustrates DisCas7-11a incubated with a crRNA targeting a double-stranded (dsDNA) target with 5' labeling of the top strand according to embodiments of the present teachings;

FIG. 19D shows the DNA sequencing analysis of selected EGFP targeting crRNA conditions on an unlabeled 400 nt EGFP ssRNA target according to embodiments of the present teachings;

FIG. 19E shows the in vitro cleavage of ssRNA 1 at 37° C. with DisCas7-11 incubated with a crRNA against the 60 nt MS2 target labeled with a 5' or 3' Cy5 molecule, wherein the target cleavage is assessed with and without crRNA, DisCas7-11 protein, and Mg+2, and arrows on the target schematic show estimated cleavage positions of DisCas7-11 cleavage according to embodiments of the present teachings;

Figure 19A:
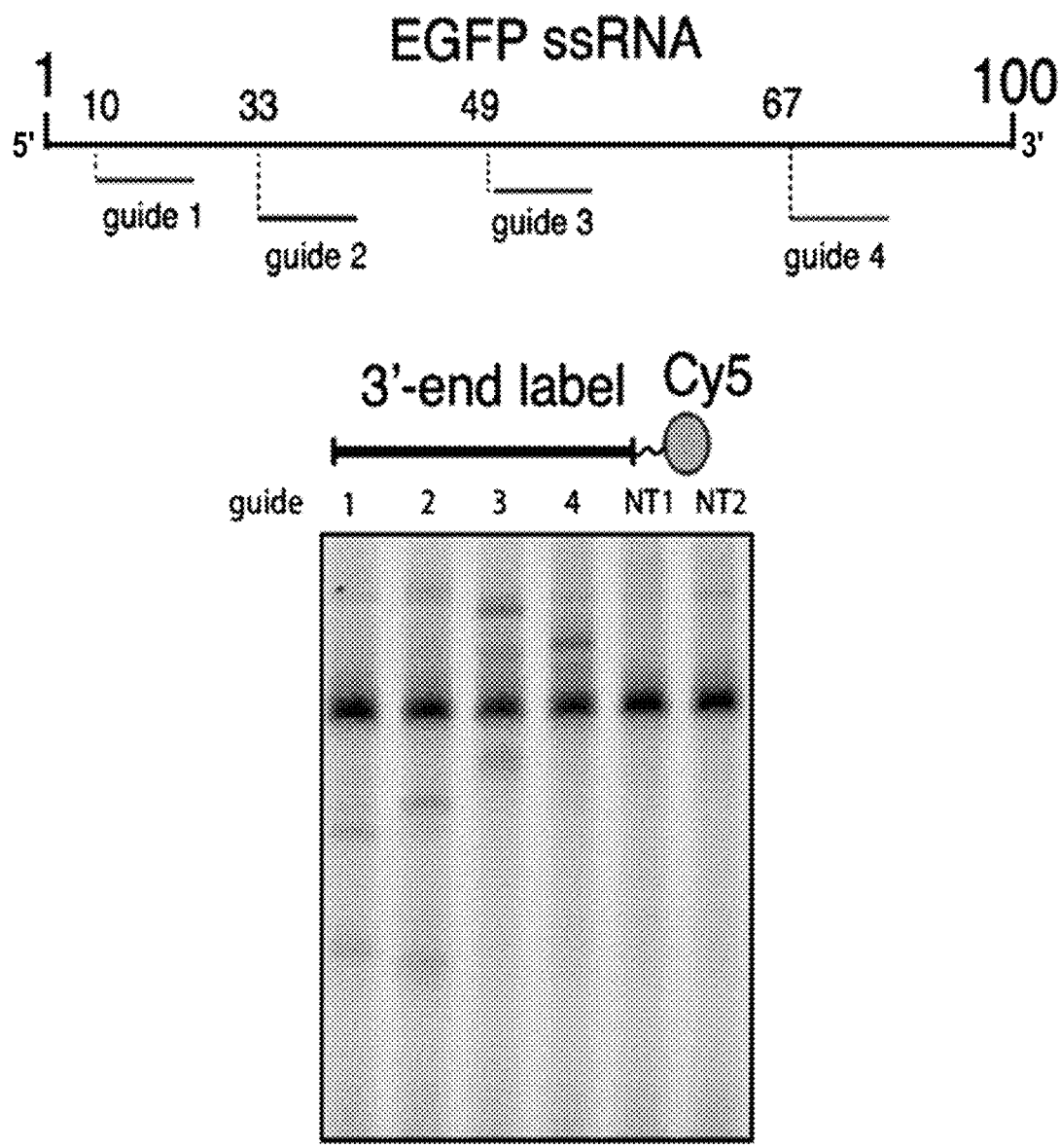
FIG. 19A shows the schematic of the position of the tested crRNAs along the 100 nt EGFP ssRNA target and the biochemical characterization of programmable DisCas7-11 RNA cleavage of 100 nt long and 3' fluorescently labeled EGFP ssRNA target with tiling crRNAs according to embodiments of the present teachings.
Figure 19B:
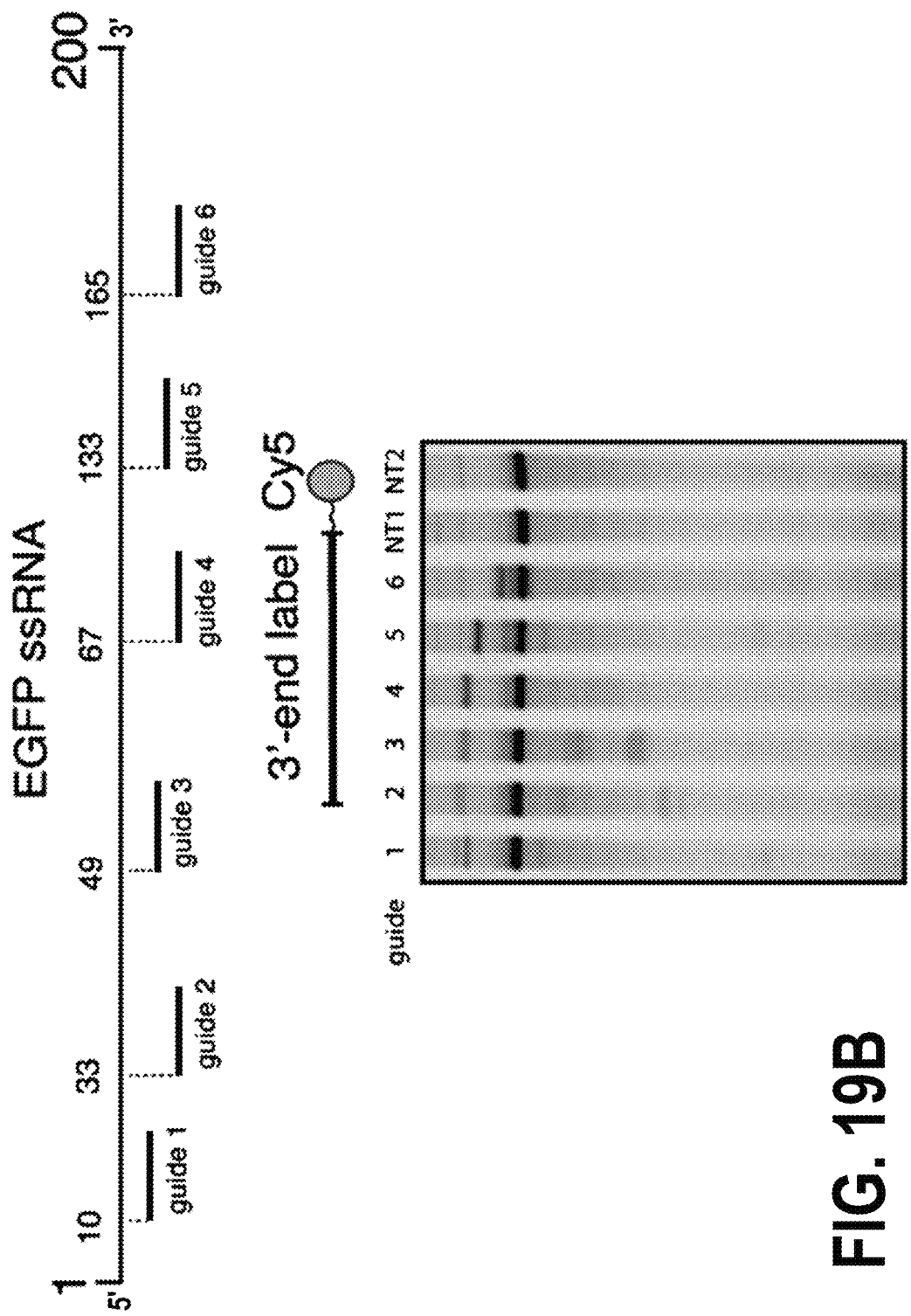
FIG. 19B shows the schematic of the position of the tested crRNAs along the 200 nt EGFP ssRNA target and the biochemical characterization of the programmable DisCas7-11 RNA cleavage of 200 nt long and 3' fluorescently labeled EGFP ssRNA target with tiling crRNAs according to embodiments of the present teachings.
Figure 19C:
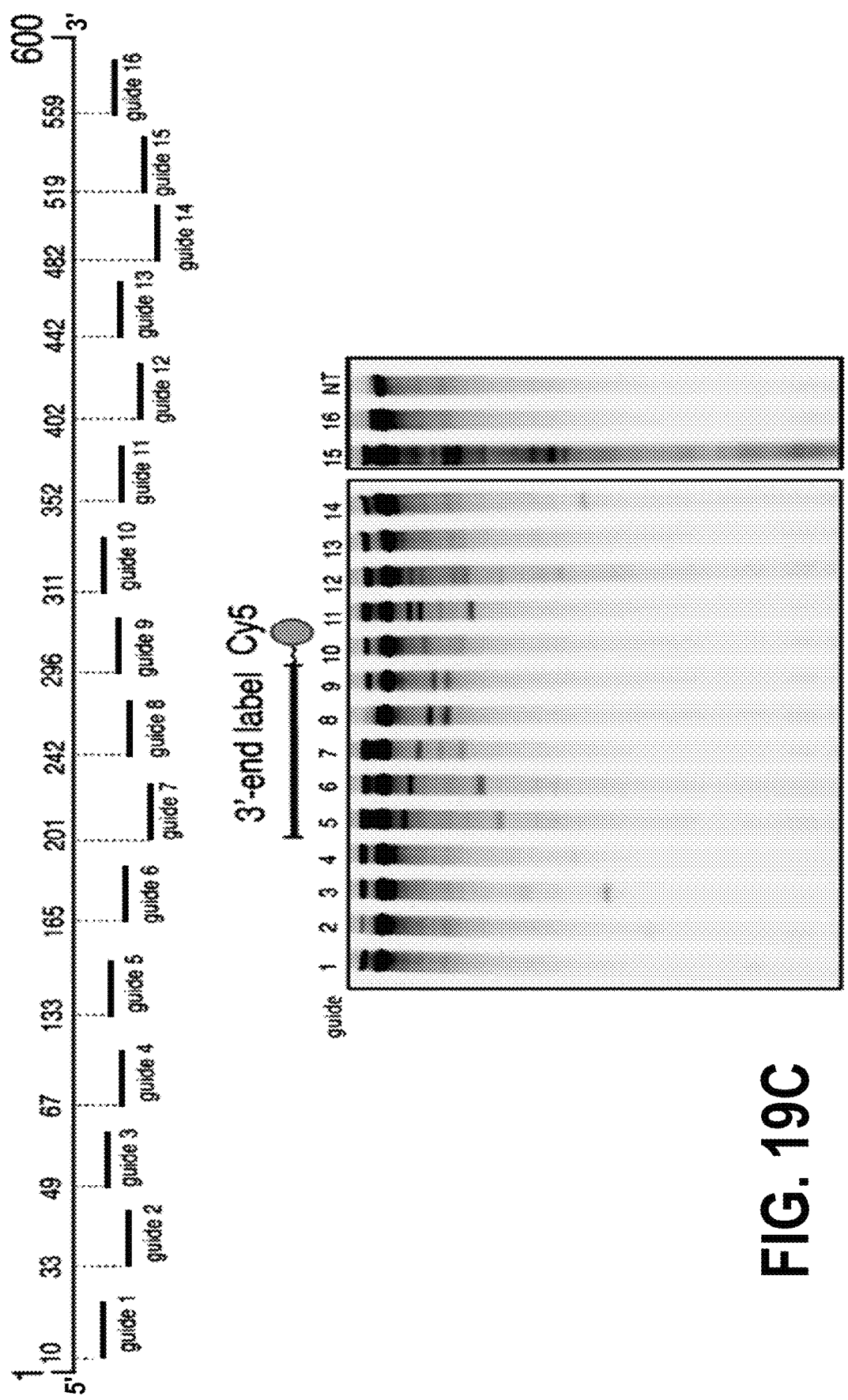
FIG. 19C shows the schematic of the position of the tested crRNAs along the 600 nt EGFP ssRNA target and the biochemical characterization of the programmable DisCas7-11 RNA cleavage of 600 nt long and 3' fluorescently labeled EGFP ssRNA target with tiling crRNAs according to embodiments of the present teachings.
Figure 19D:
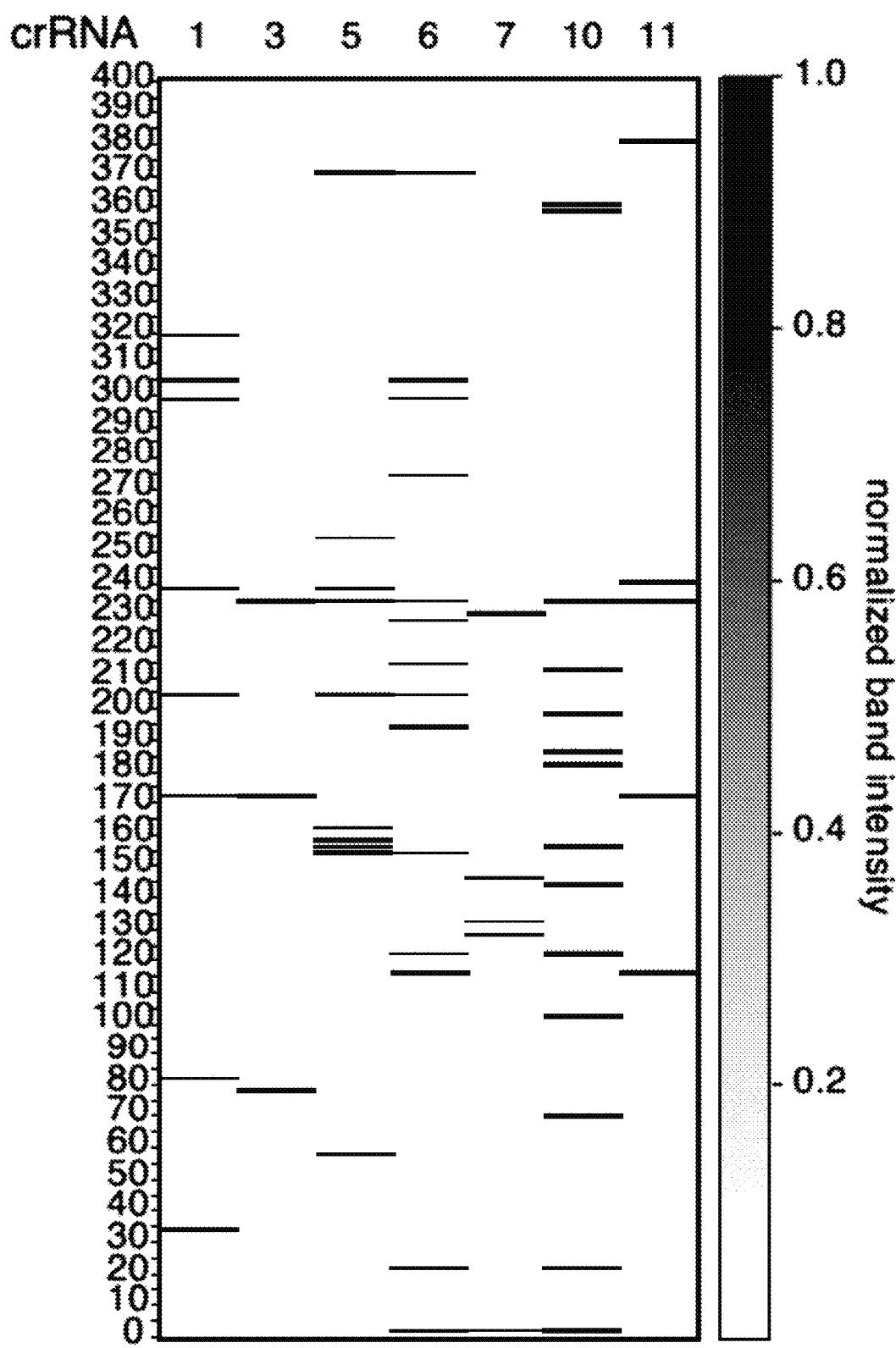
Figure 19E:
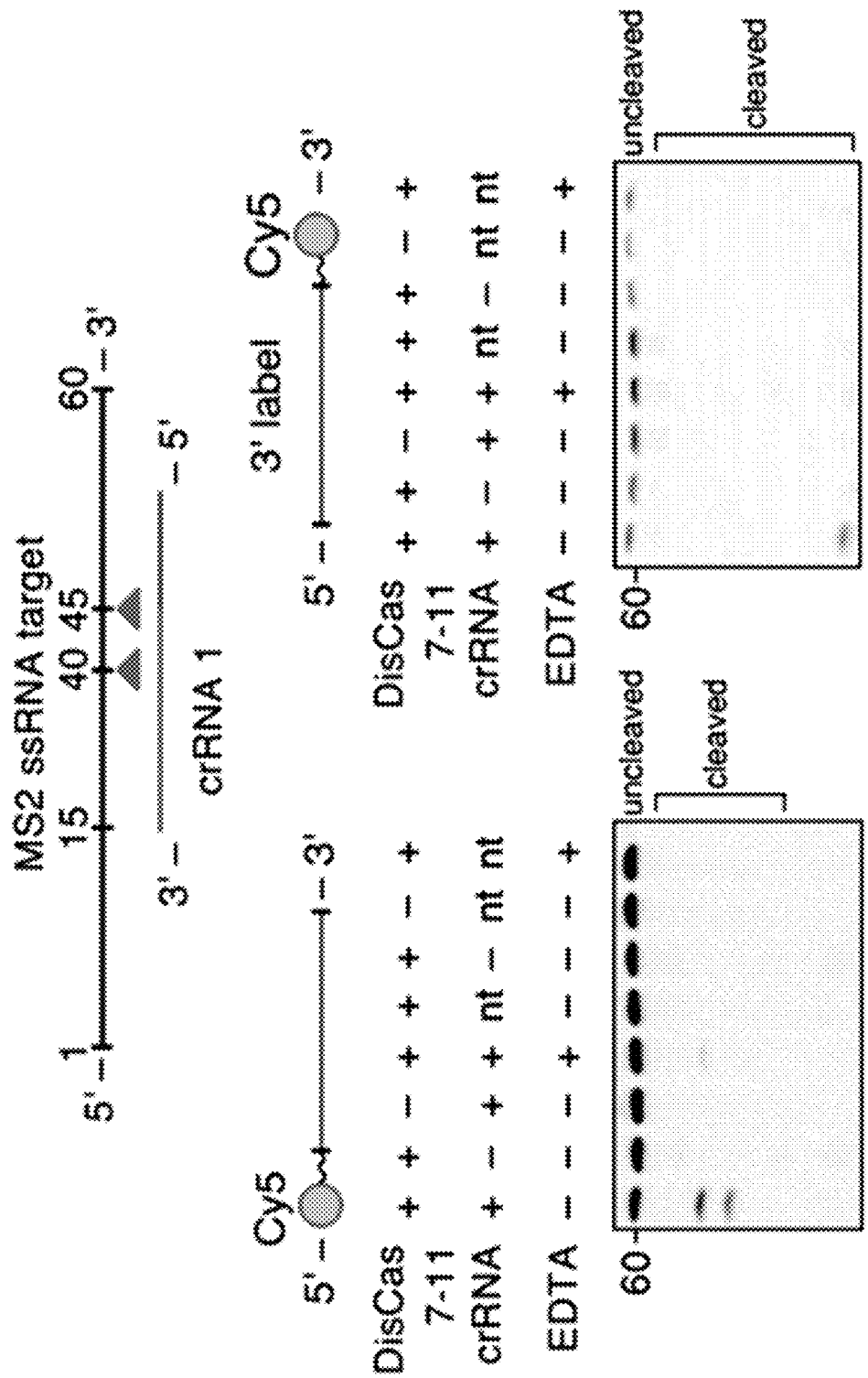
Figure 19F:
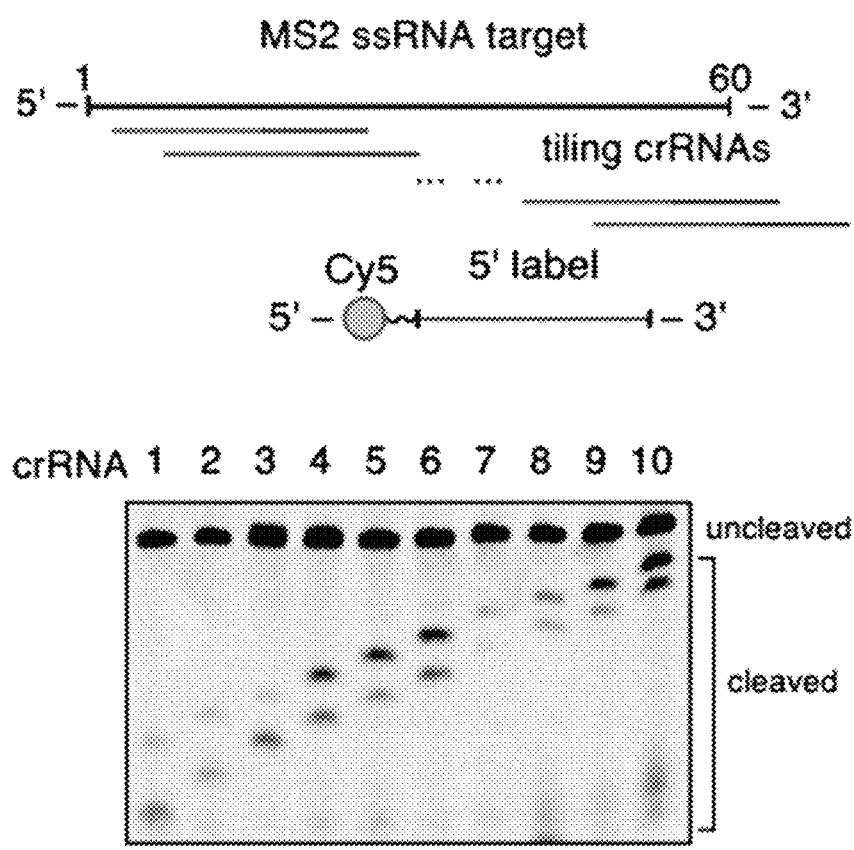
Figure 19G:
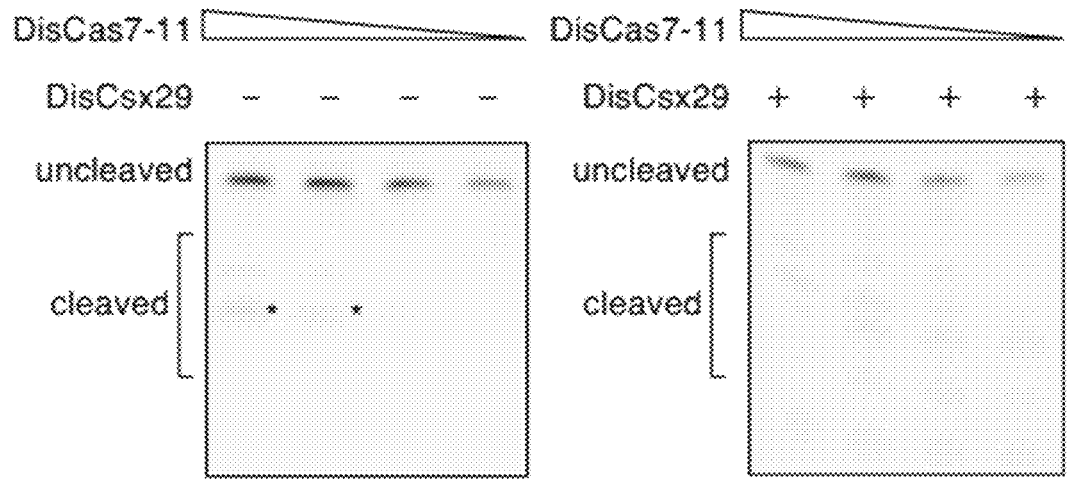

FIG. 19F shows cleavage of MS2 ssRNA at multiple sites with tiled crRNAs via incubation with DisCas7-11 protein, wherein MS2 ssRNA target is 5' labeled with Cy5 according to embodiments of the present teachings; and FIG. 19G shows in vitro cleavage of MS2 ssRNA at 37° C. with varying concentrations of DisCas7-11 incubated with a crRNA against the target with and without Csx29 protein, wherein MS2 ssRNA target is 5' labeled with Cy5 and cleavage bands are marked by asterisks according to embodiments of the present teachings.

Figure 20:
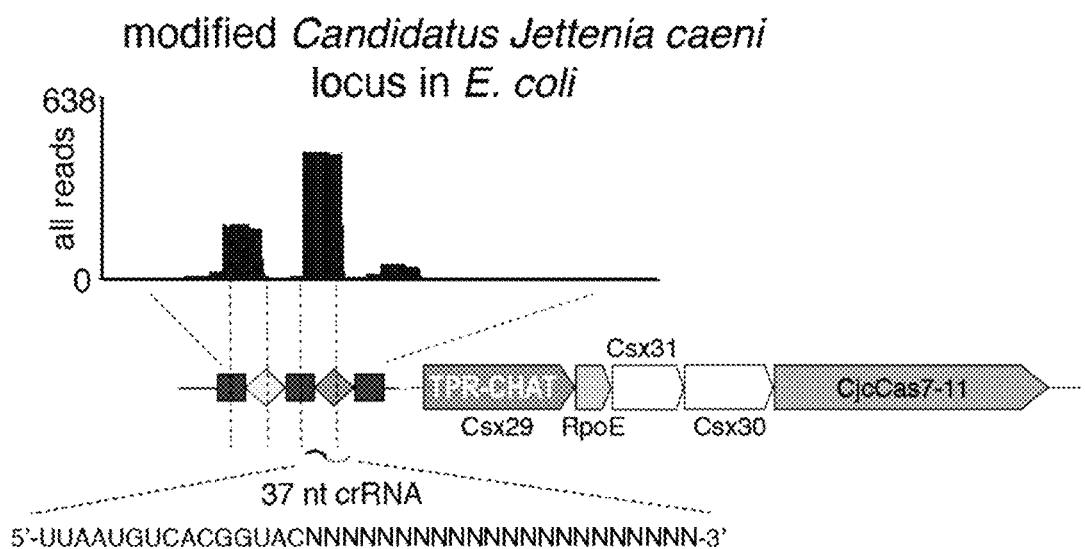
Figure 21A:
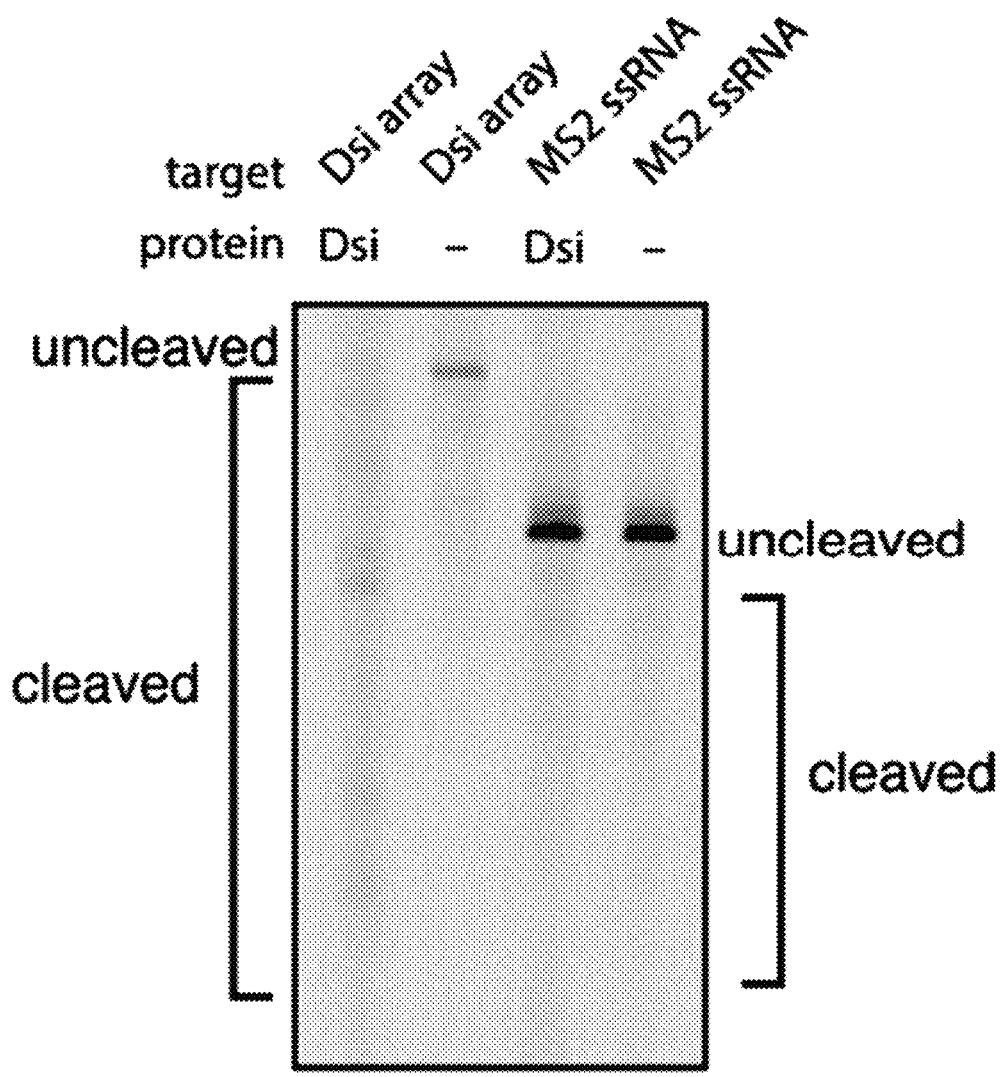
Figure 21B:
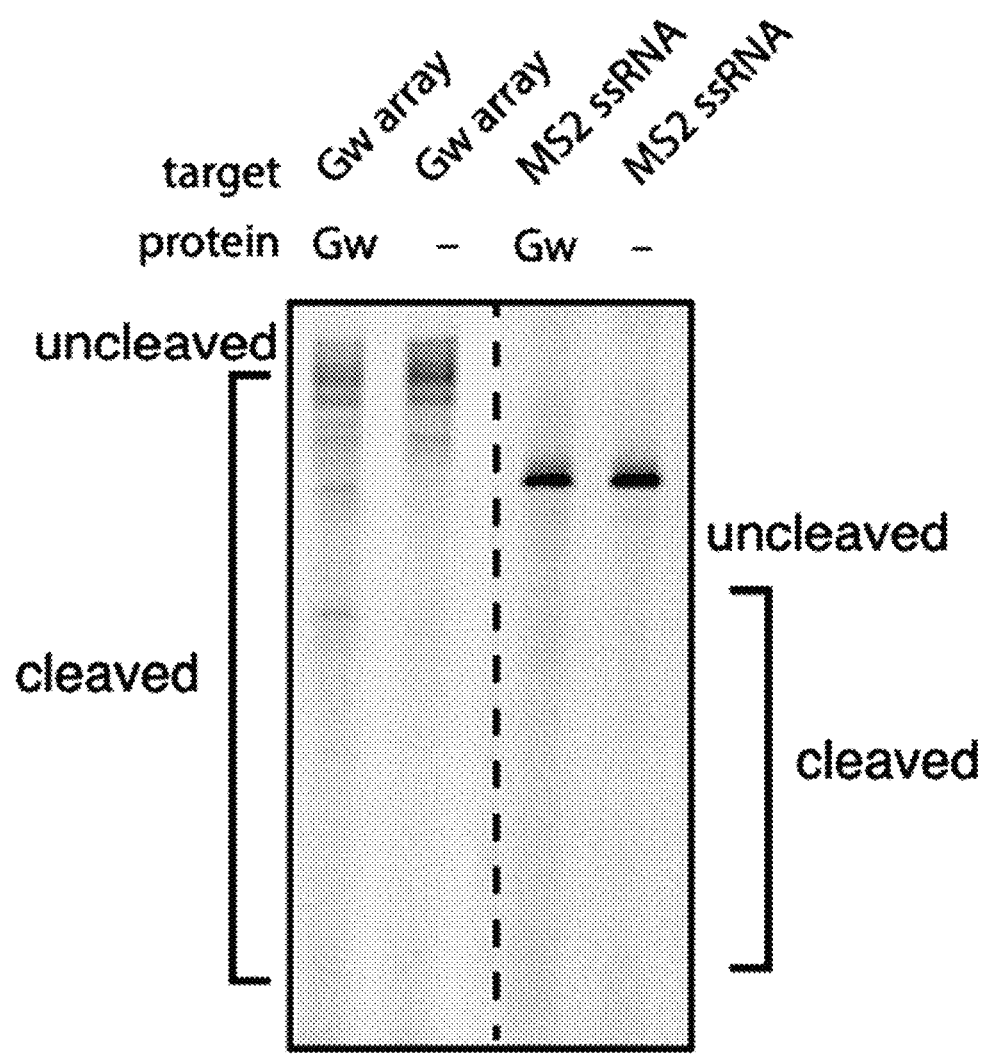

FIG. 20 illustrates the heterologous expression of the Candidatus *Jettenia caeni* Type III-E CRISPR-Cas system and associated CRISPR array in *E. coli*. according to embodiments of the present teachings. Figure discloses SEQ ID NO: 644;

FIG. 21A illustrates the processing of DisCas7-11 ortholog according to embodiments of the present teachings;

FIG. 21B illustrates the processing of GwCas7-11 ortholog according to embodiments of the present teachings.

Figure 21C:
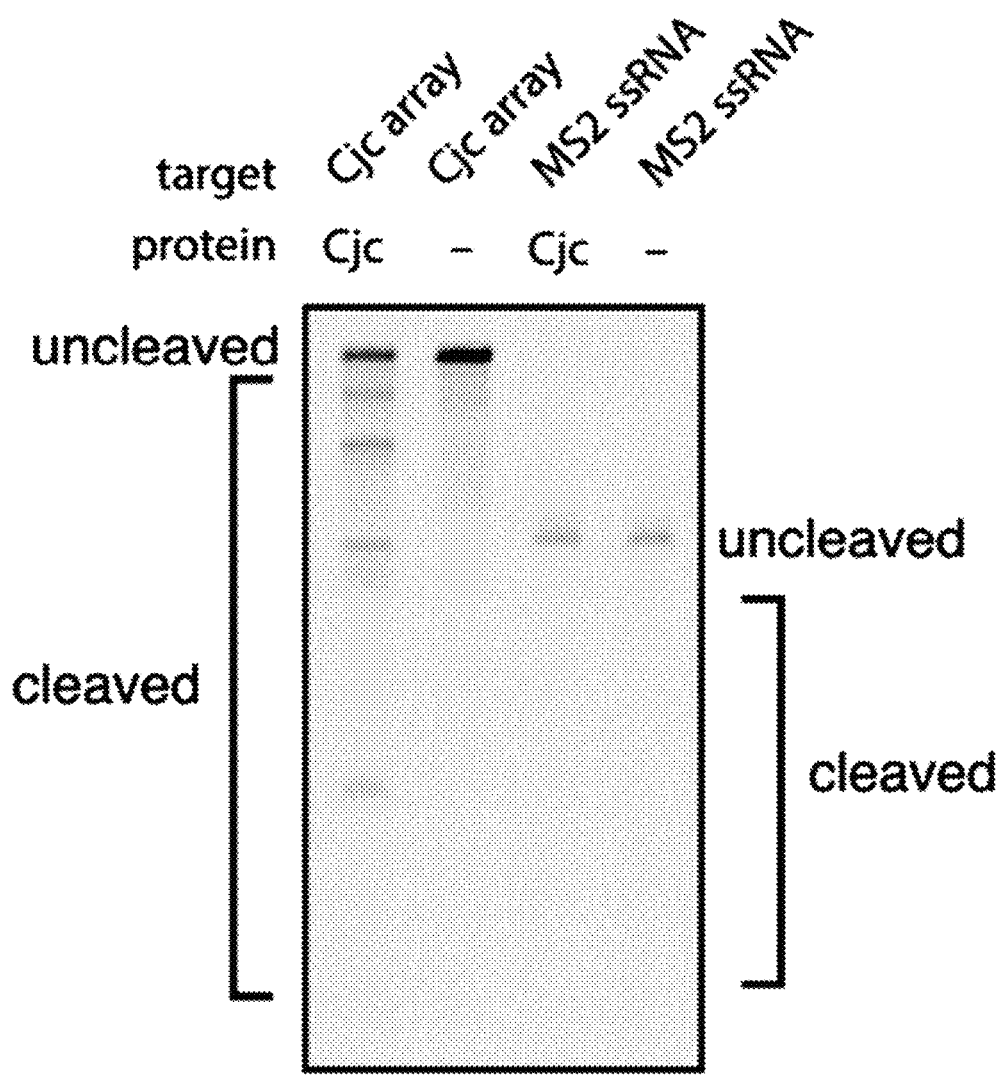
Figure 21D:
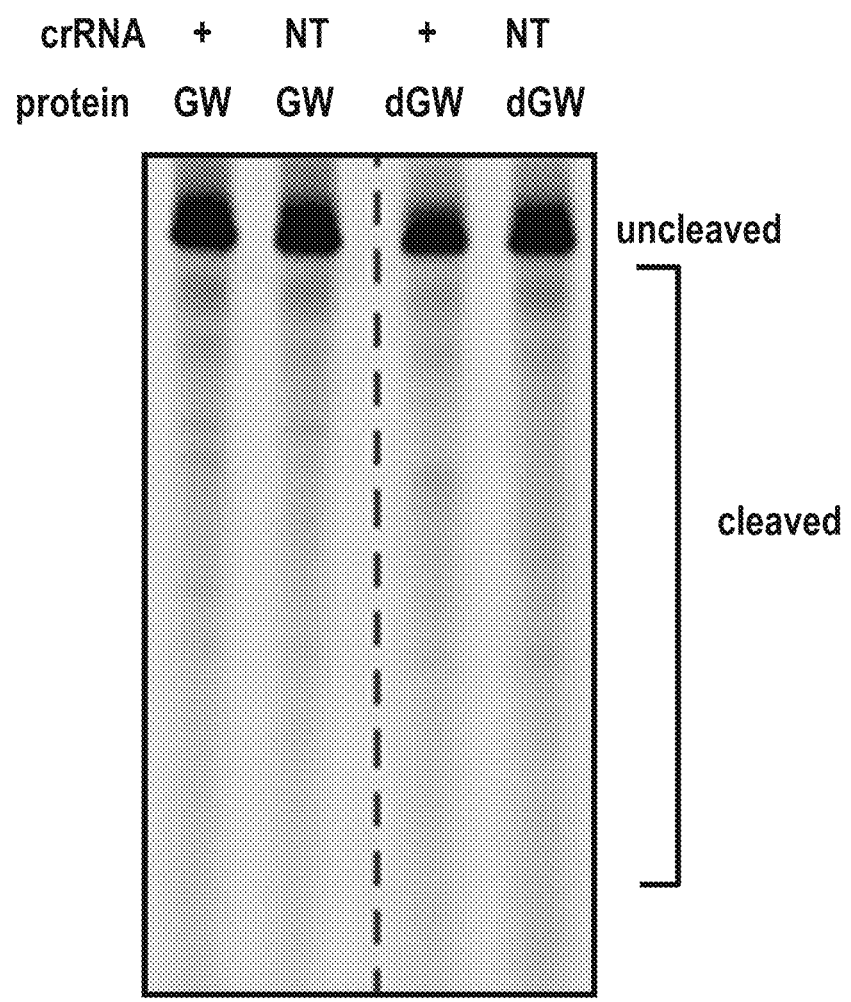
Figure 22A:
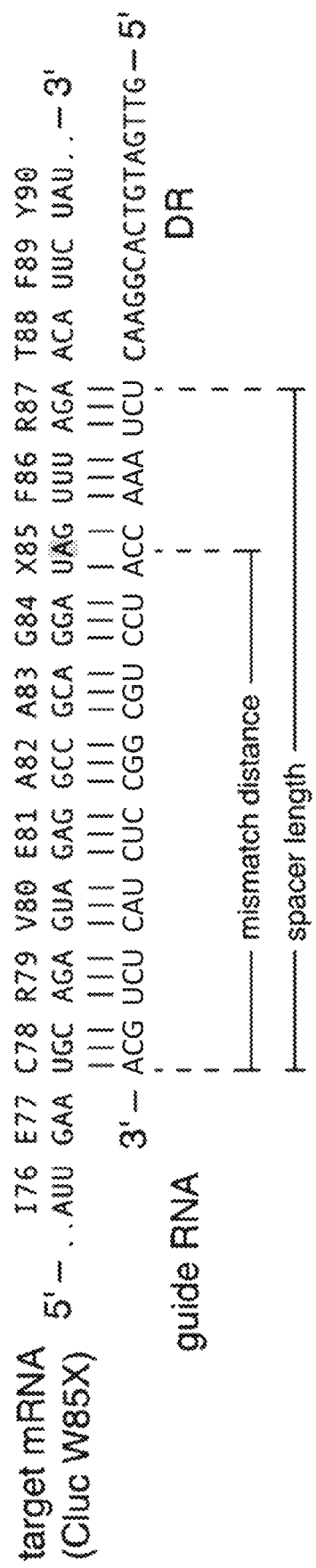
Figure 22C:
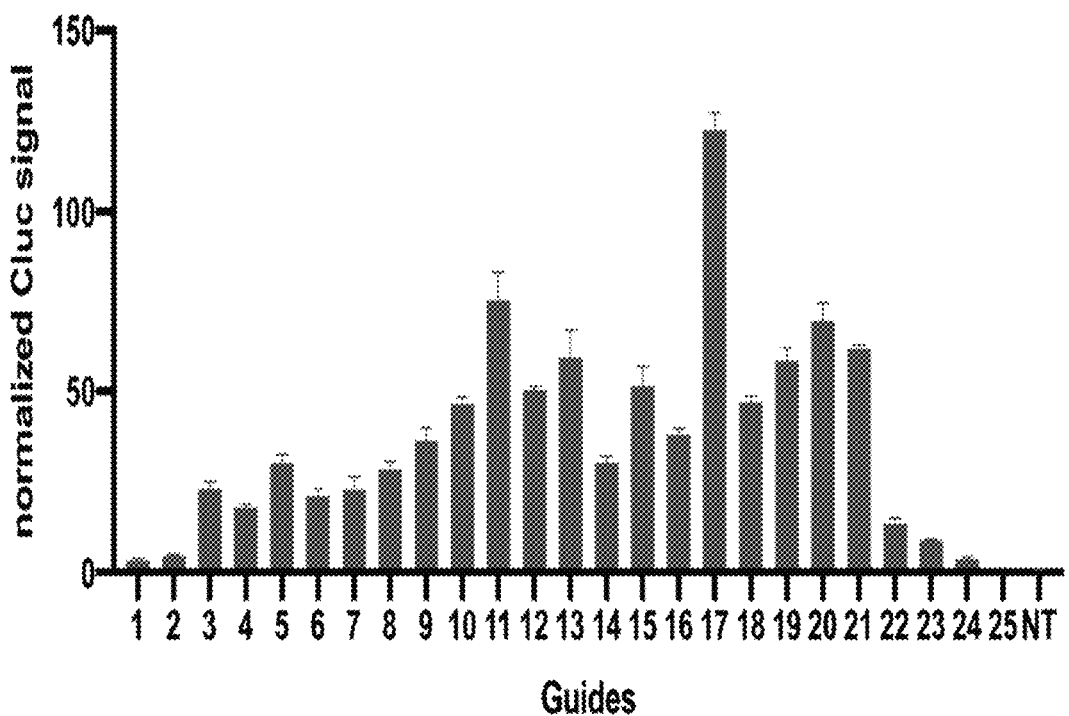
Figure 22D:
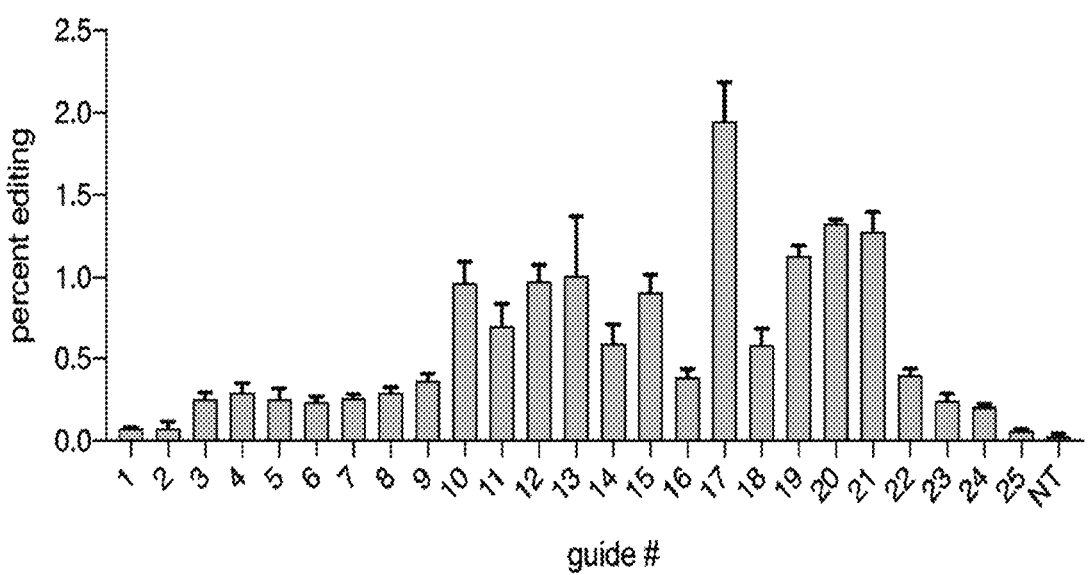
Figure 22E:
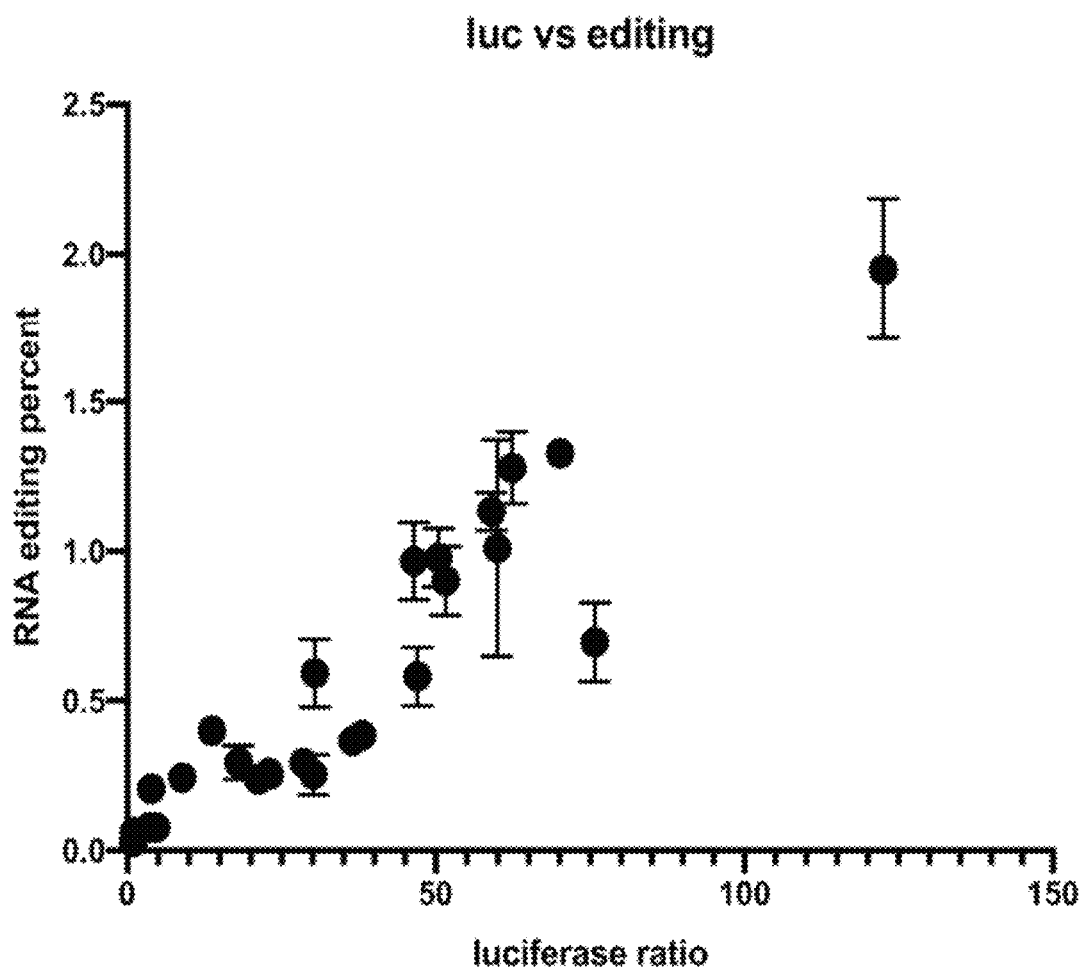
Figure 23A:
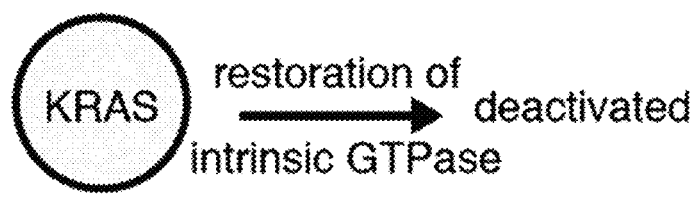
Figure 23B:
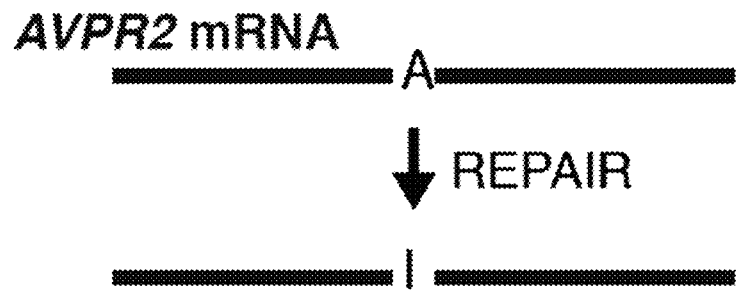
Figure 23C:
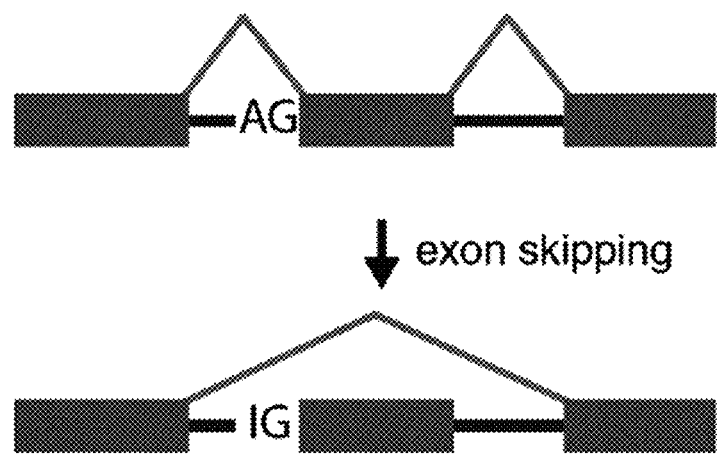
Figure 25:
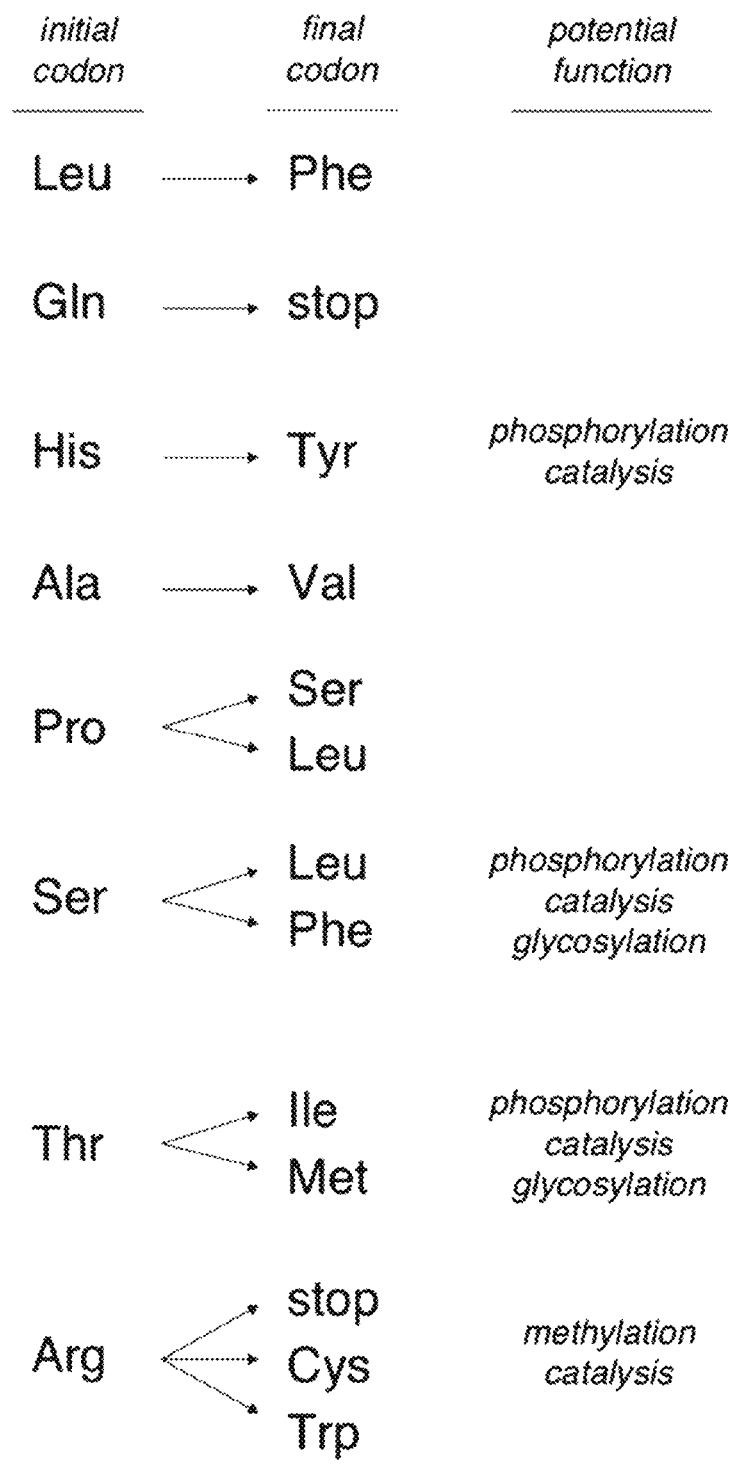
Figure 26A:
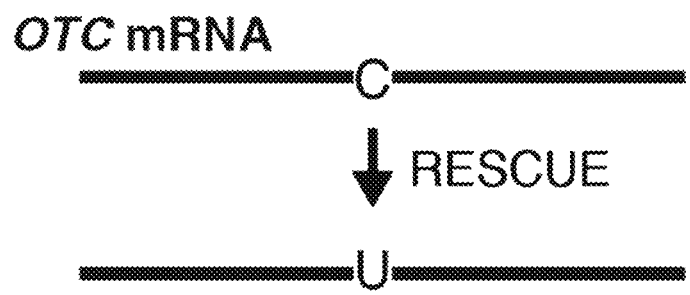
Figure 26B:
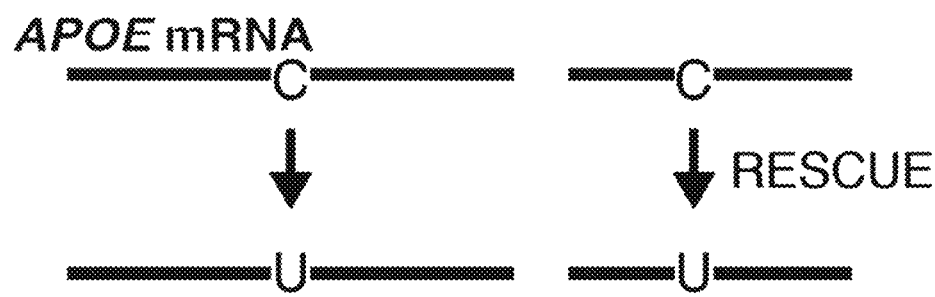
Figure 26C:
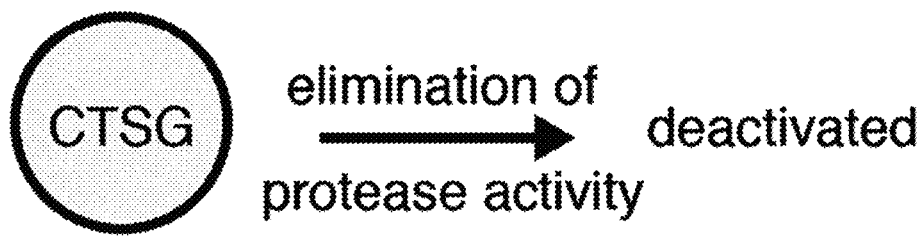
Figure 26D:
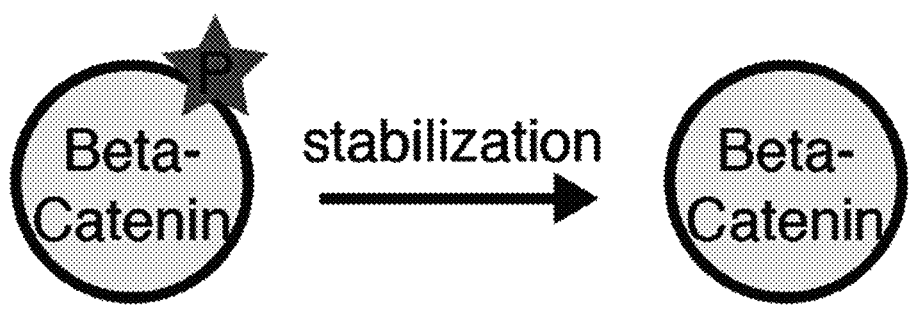
Figure 28A:
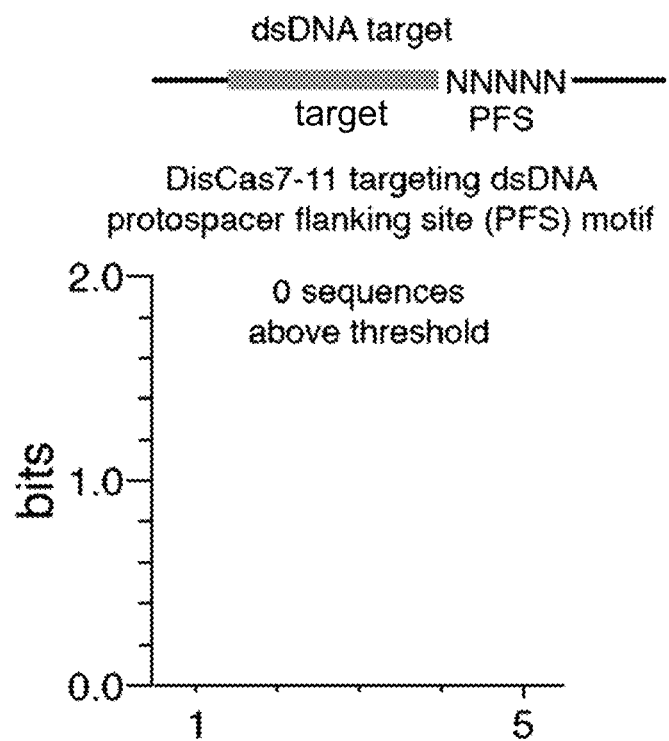
Figure 28B:
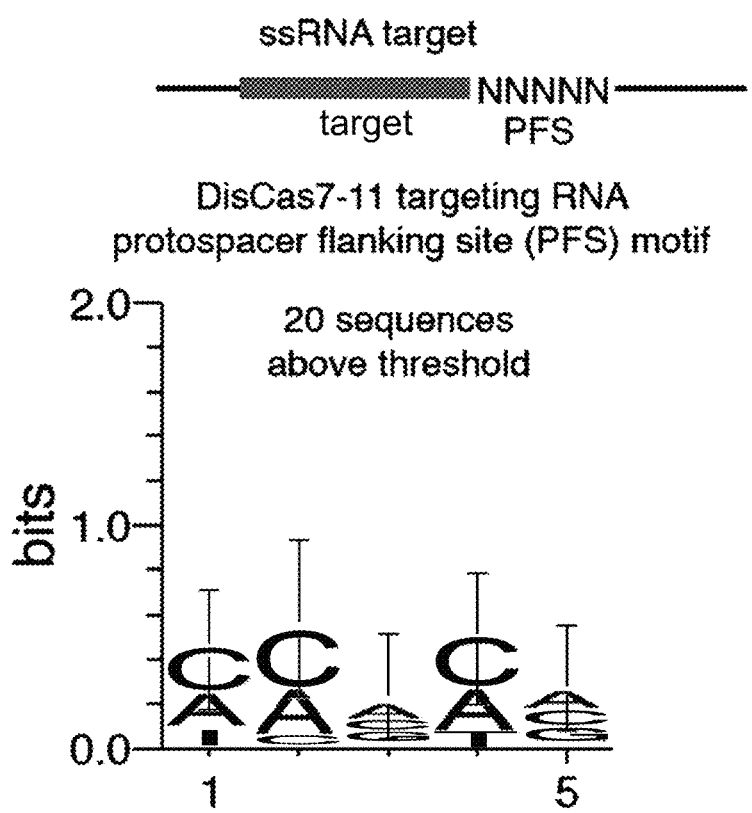
Figure 28C:
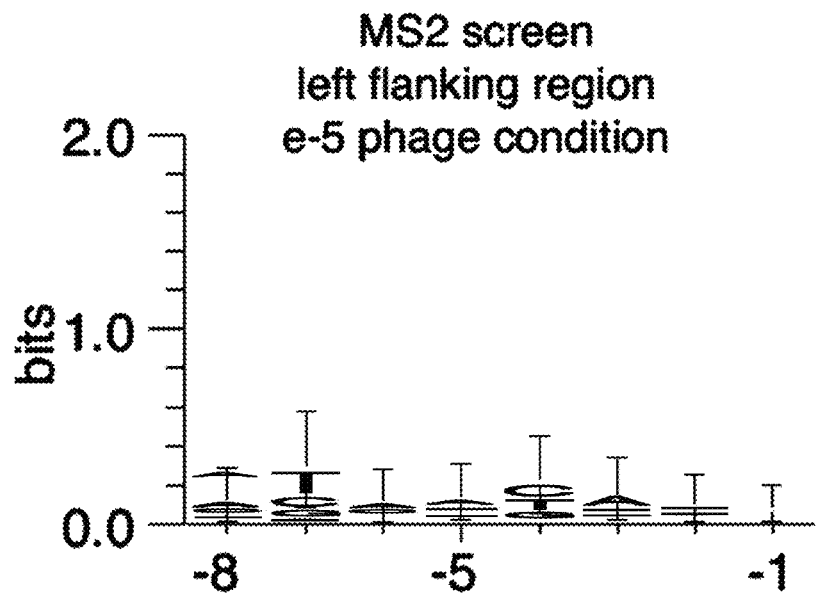
Figure 28D:
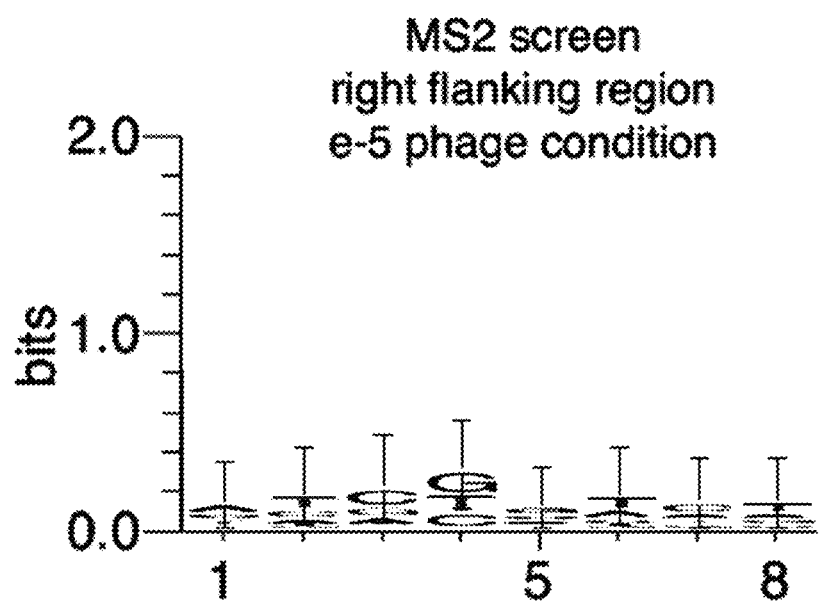
Figure 28E:
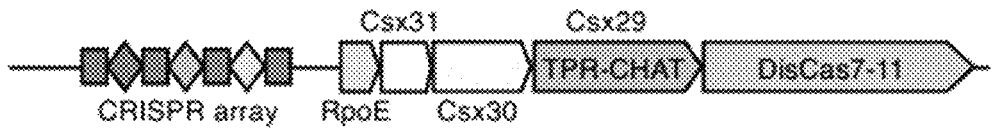
Figure 28F:
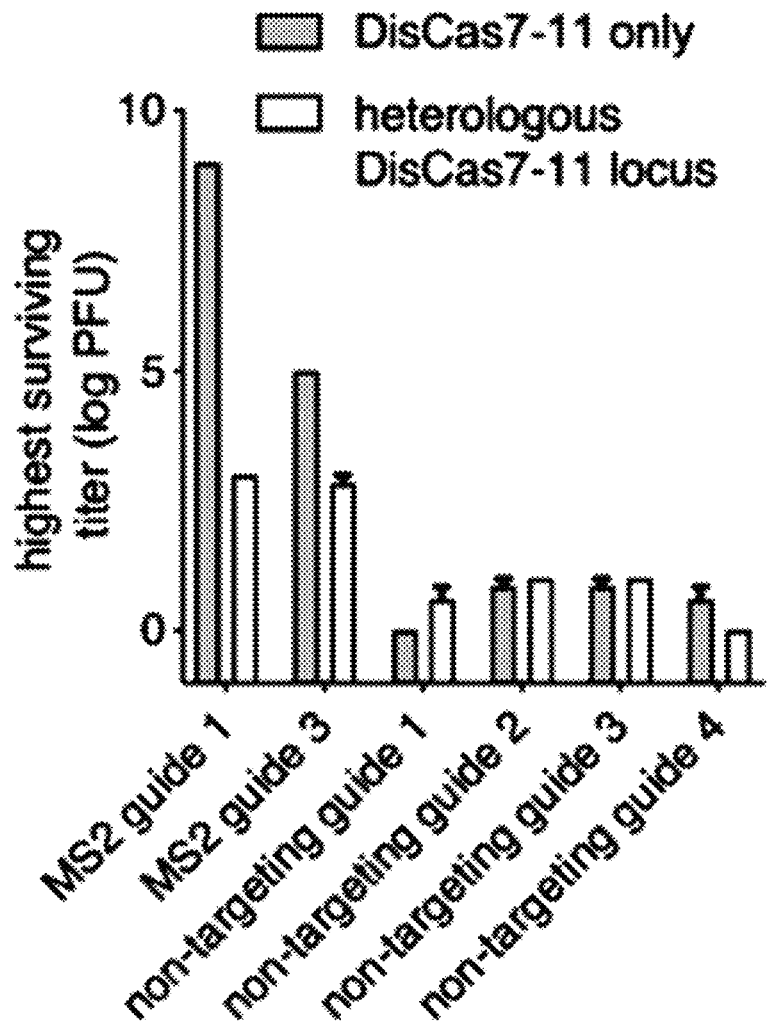
Figure 28G:
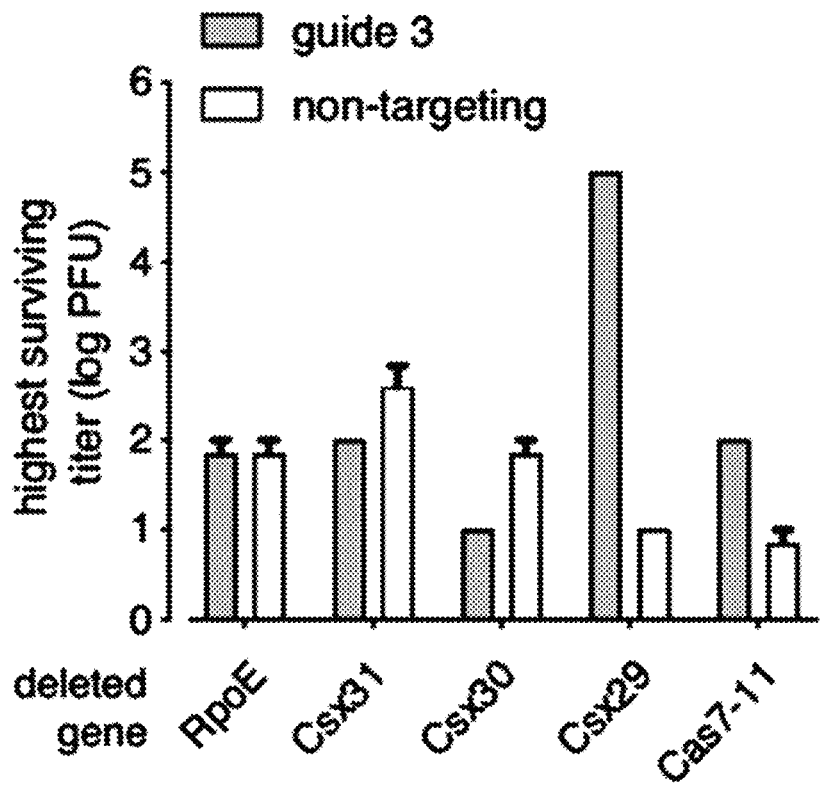
Figure 29:
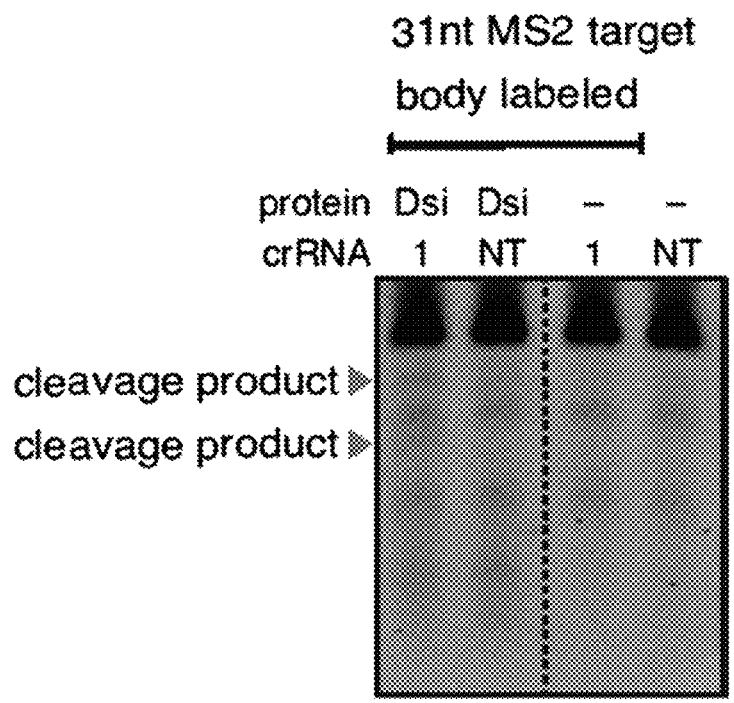
Figure 30A:
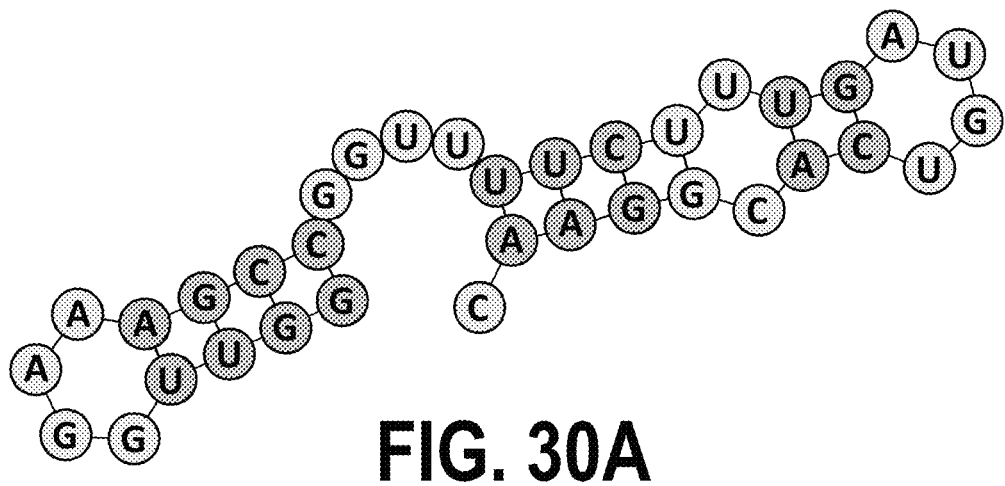
Figure 30B:
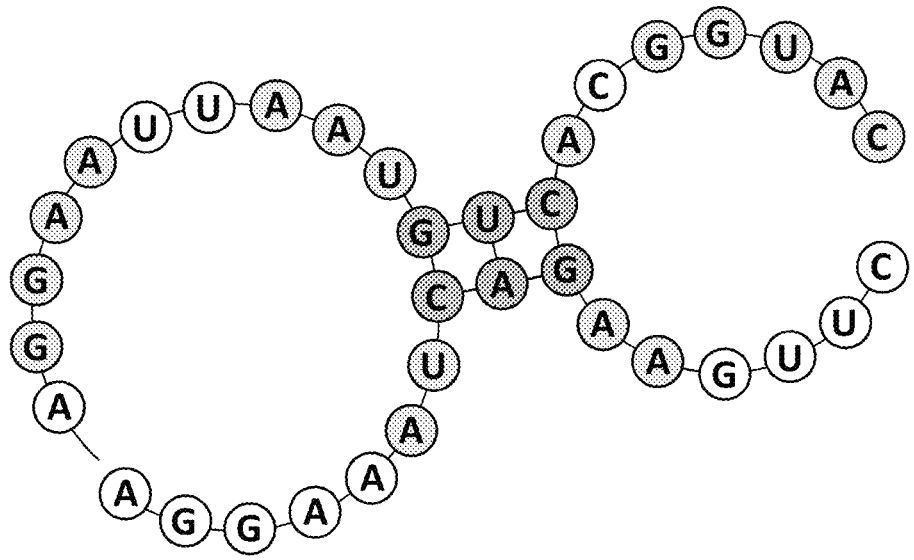
Figure 30C:
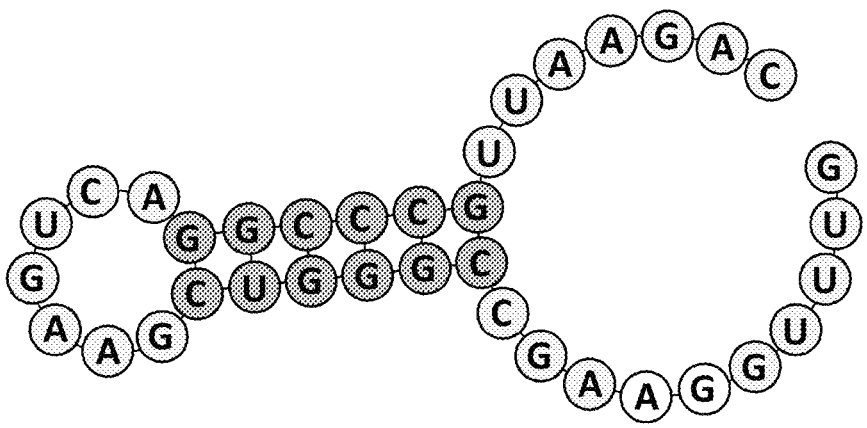
Figure 31A:
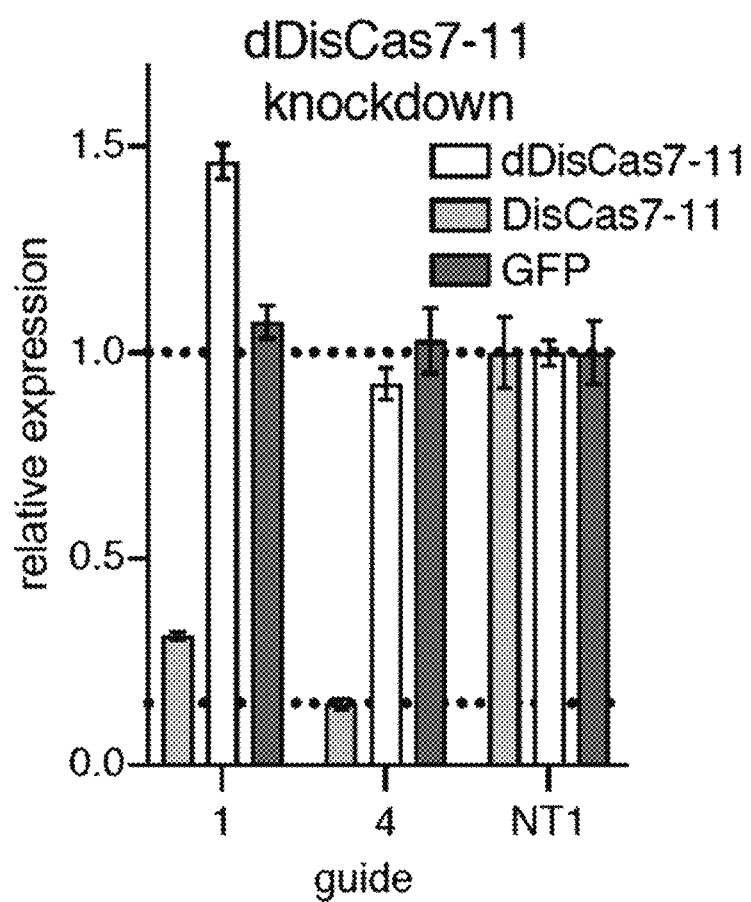
Figure 31B:
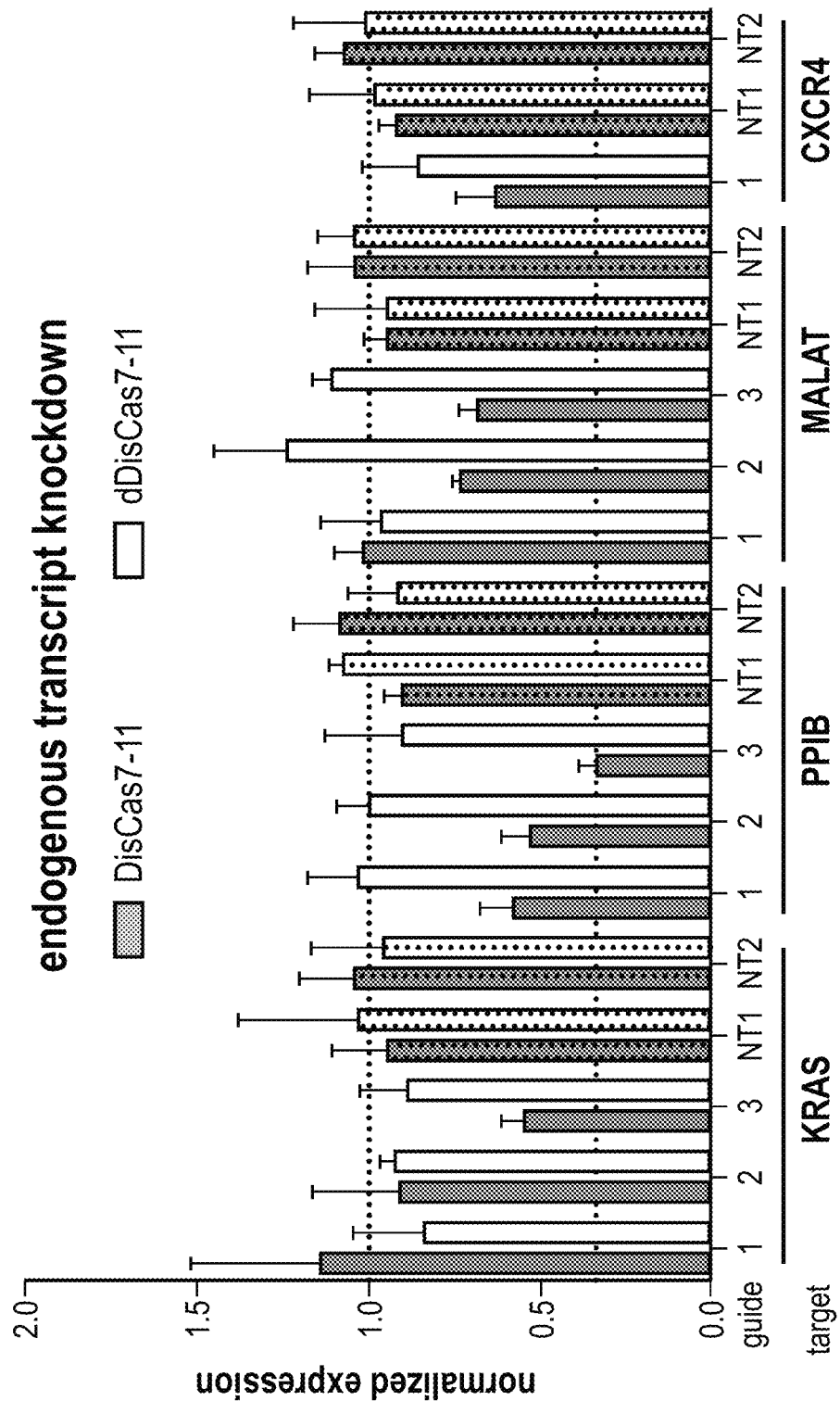
Figure 32A:
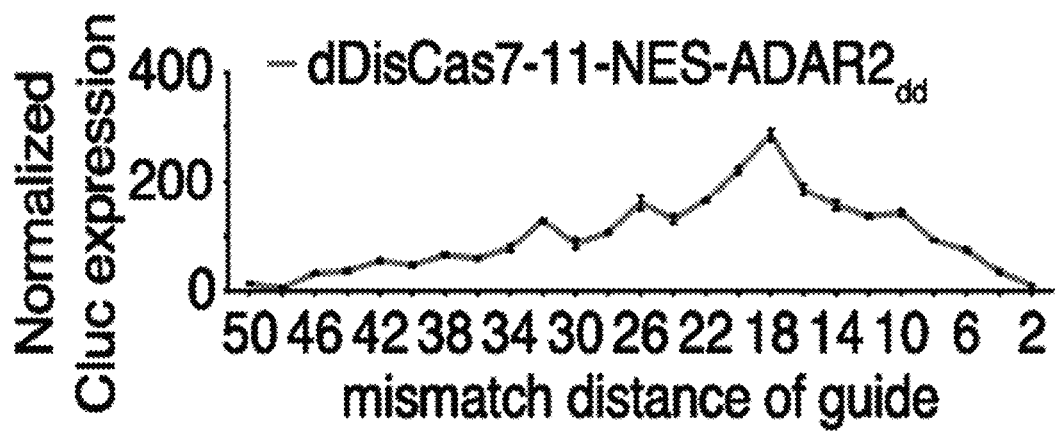
Figure 32B:
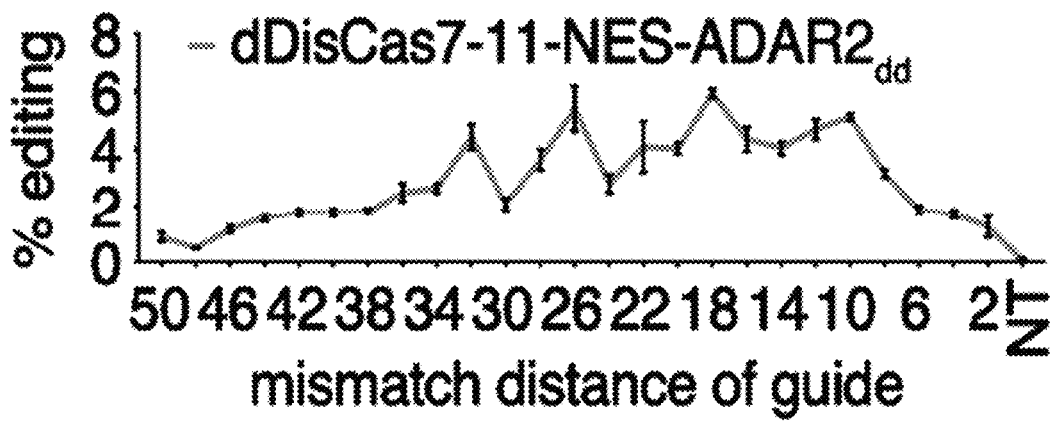
Figure 33A:
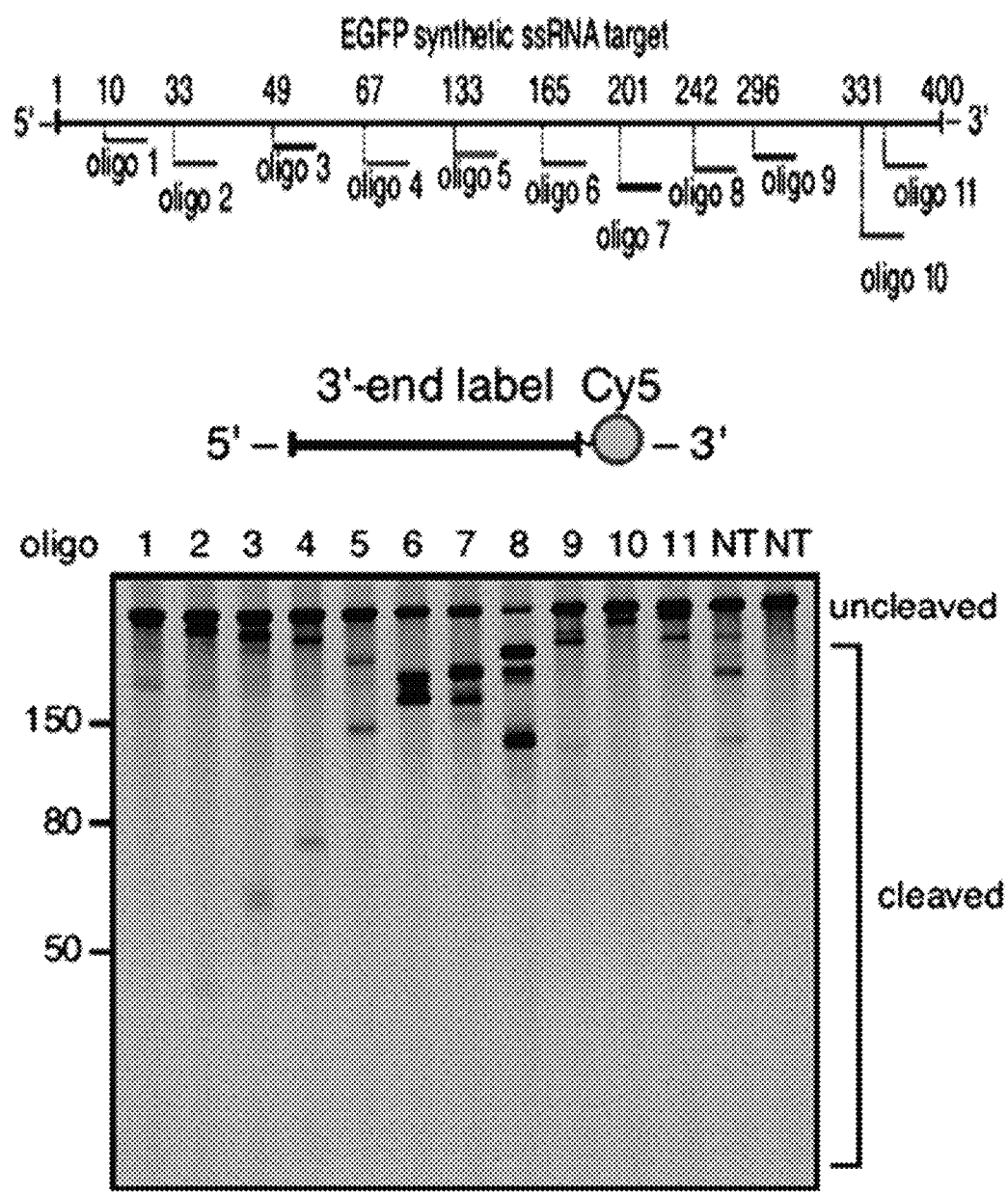
Figure 33B:
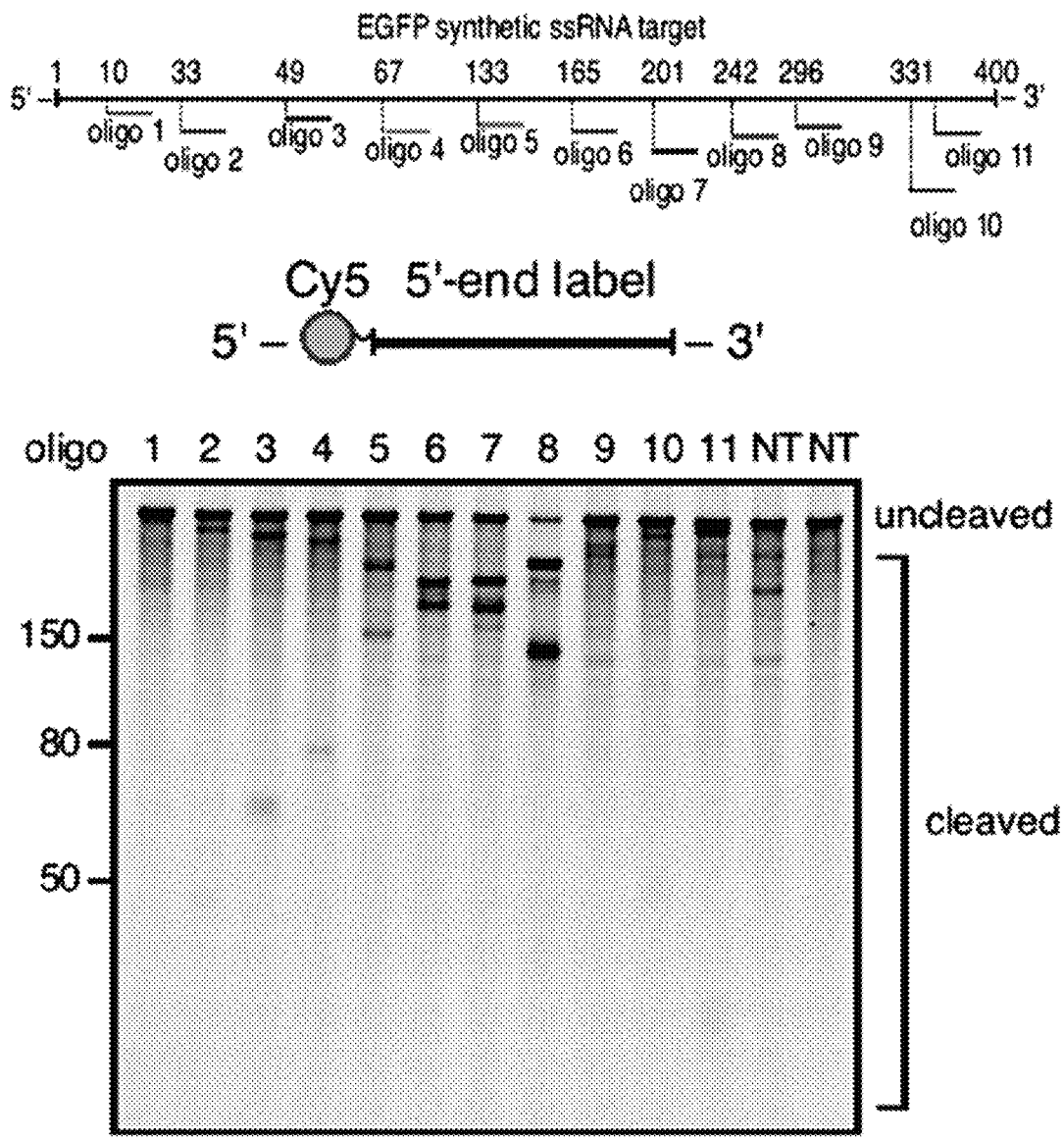

FIG. 21C illustrates the processing of CjcCas7-11 ortholog according to embodiments of the present teachings;

FIG. 21D illustrates a comparison of target cleavages between active CjcCas7-11 and dead CjcCas7-11 according to embodiments of the present teachings;

FIG. 22A illustrates the DisCas7-11 guide design for RNA editing according to embodiments of the present teachings. Figure discloses SEQ ID NOS 639-640, respectively, in order of appearance;

FIG. 22B is a table showing the DisCas7-11 ADAR guide designs for according to embodiments of the present teachings. Figure discloses SEQ ID NOS 425-446, 645-647, and 411, respectively, in order of appearance;

FIG. 22C is diagram showing the dDisCas7-11 correction of Cluc W85X RNA according to embodiments of the present teachings;

FIG. 22D is a diagram showing the dDisCas7-11 correction of RNA as measured by sequencing according to embodiments of the present teachings;

FIG. 22E is a diagram showing the luciferase correction that correlates to the correction percent according to embodiments of the present teachings;

FIG. 23A illustrates the modulation of protein function that requires temporal A to G modulation according to embodiments of the present teachings;

FIG. 23B illustrates the correction of mendelian disease that requires temporal A to G modulation according to embodiments of the present teachings;

FIG. 23C illustrates a slicing modulation that requires temporal A to G modulation according to embodiments of the present teachings;

Figure 24B:
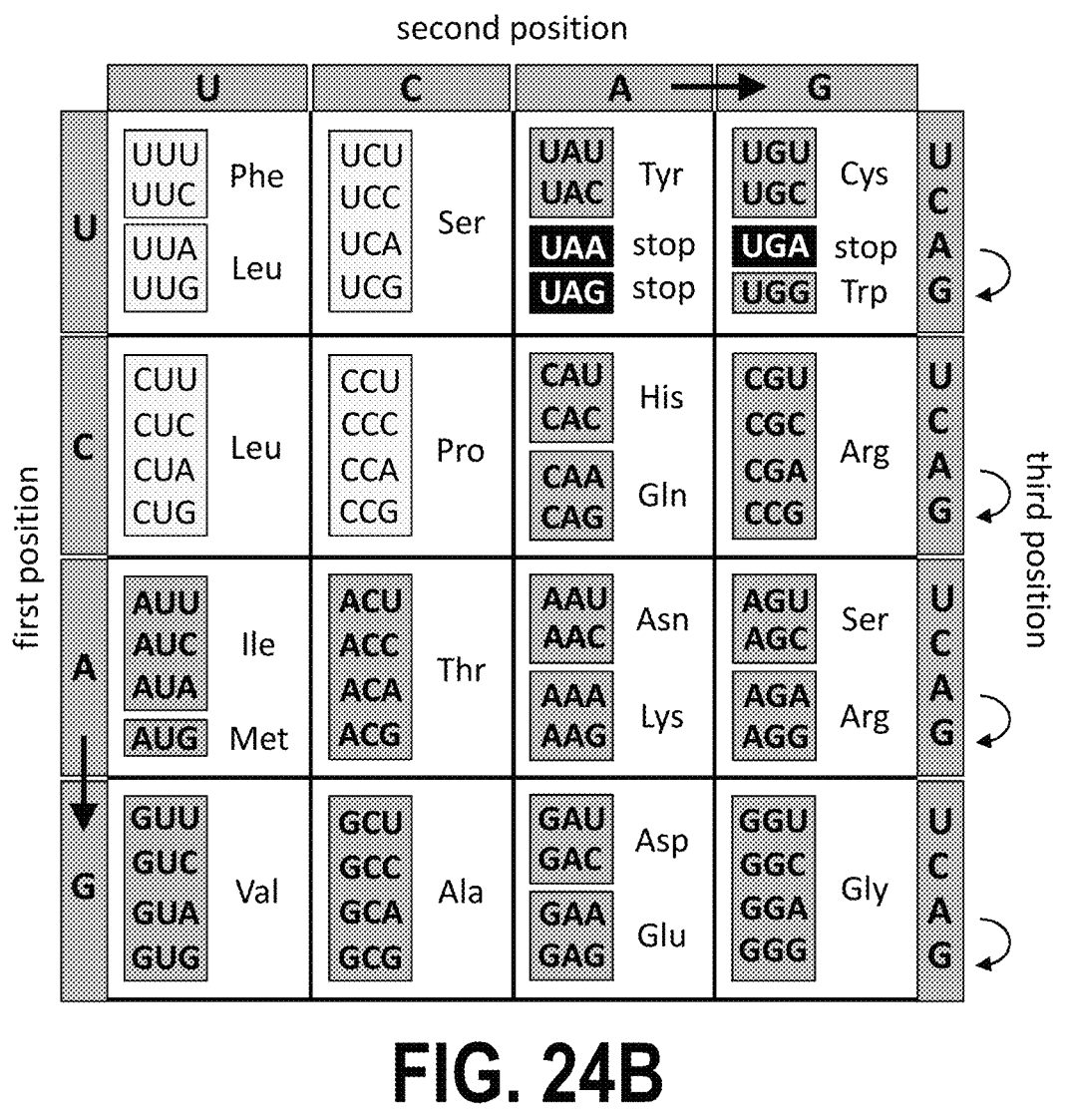

FIG. 24A illustrates the initial and edited codon for protein modifications with A to G RNA editing according to embodiments of the present teachings;

FIG. 24B illustrates first, second and third position codon modifications in RNA editing according to embodiments of the present teachings;

FIG. 25 illustrates the initial codon, final codon and potential function in protein modifications with C to U RNA editing according to embodiments of the present teachings;

FIG. 26A illustrates the correction of mendelian disease that requires C to U RNA editing according to embodiments of the present teachings;

FIG. 26B illustrates the multiplexed creation of disease-protective alleles that requires C to U RNA editing according to embodiments of the present teachings;

FIG. 26C illustrates the modulation of catalytic activity that requires C to U RNA editing according to embodiments of the present teachings;

FIG. 26D illustrates alter post-translation modifications that requires C to U RNA editing according to embodiments of the present teachings;

FIG. 27A-27C are tables of Cas7-11 effectors according to embodiments of the present teachings;

FIG. 28A illustrates the targeting of DisCas7-11 RNA target in beta-lactamase (ampicillin resistance gene) and the resulting PFS determined by 20 depleted targets according to embodiments of the present teachings;

FIG. 28B illustrates the targeting of DisCas7-11 DNA target in a plasmid, with a motif corresponding to no significantly depleted PFS sequences according to embodiments of the present teachings;

FIG. 28C is a diagram showing the PFS analysis of top spacers from the MS2 phage screen (e-5 condition) in the 8 bp flanking the target region to the left according to embodiments of the present teachings;

FIG. 28D is a diagram showing the PFS analysis of top spacers from the MS2 phage screen (e-5 condition) in the 8 bp flanking the target region to the right according to embodiments of the present teachings;

FIG. 28E is a schematic of the heterologous type III-E locus of the *Desulfonema ishimotonii* according to embodiments of the present teachings;

FIG. 28F is a bar graph showing the phage plaque assay of the Type III-E DisCas7-11 effector alone and as part of it entire locus according to embodiments of the present teachings;

FIG. 28G is a bar graph showing the phage plaque assay of *E. coli* transformed with the DisCas7-11 locus containing according to embodiments of the present teachings;

FIG. 29 illustrates the DisCas7-11a cleavage of synthetic 31 nt MS2 ssRNA with a 31 nt crRNA according to embodiments of the present teachings;

FIG. 30A shows the secondary structure folding prediction of the DisCas7-11a DR according to embodiments of the present teachings. Figure discloses SEQ ID NO: 634;

FIG. 30B shows the secondary structure folding prediction of the CjcCas7-11b DR according to embodiments of the present teachings. Figure discloses SEQ ID NO: 638;

FIG. 30C shows the structure folding prediction of the GwCas7-11c DR in accordance with embodiments of the present teachings. Figure discloses SEQ ID NO: 637;

FIG. 31A illustrates the comparison of knockdown activity of Gluc mRNA in mammalian cells between active DisCas7-11a, catalytically inactive D429A/D654A DisCas7-11a, and GFP according to embodiments of the present teachings;

FIG. 31B illustrate the comparison of knockdown activity of endogenous mRNA in mammalian cells between active DisCas7-11a, catalytically inactive D429A/D654A DisCas7-11a, and GFP according to embodiments of the present teachings;

FIG. 32A is a diagram of the RNA A-to-I editing of *Cypridinia* luciferase (cluc) mRNA W85X mutation in mammalian cells by active DisCas7-11a-NES-ADAR2 or dead DisCas7-11a-NES-ADAR2 according to embodiments of the present teachings;

FIG. 32B is a diagram of the RNA A-to-I editing of *Cypridinia* luciferase (cluc) mRNA W85X mutation in mammalian cells by active DisCas7-11a-NES-ADAR2 or dead DisCas7-11a-NES-ADAR2 according to embodiments of the present teachings;

FIG. 33A shows the cleavage of 3' labeled targeted by incubation with RNase H according to embodiments of the present teachings;

FIG. 33B shows the cleavage of 5' labeled targeted by incubation with RNase H according to embodiments of the present teachings;

Figure 34A:
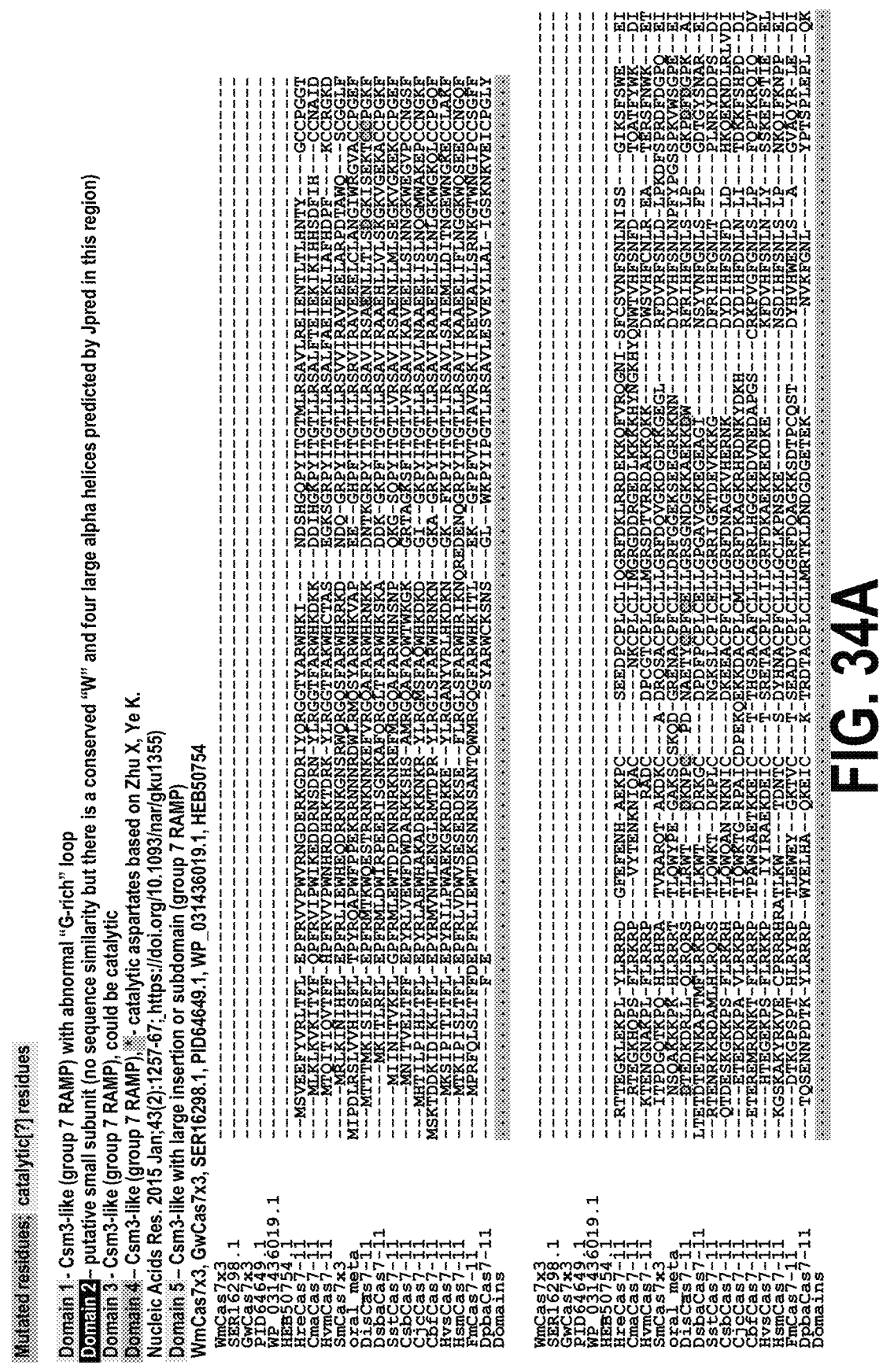
Figure 34B:
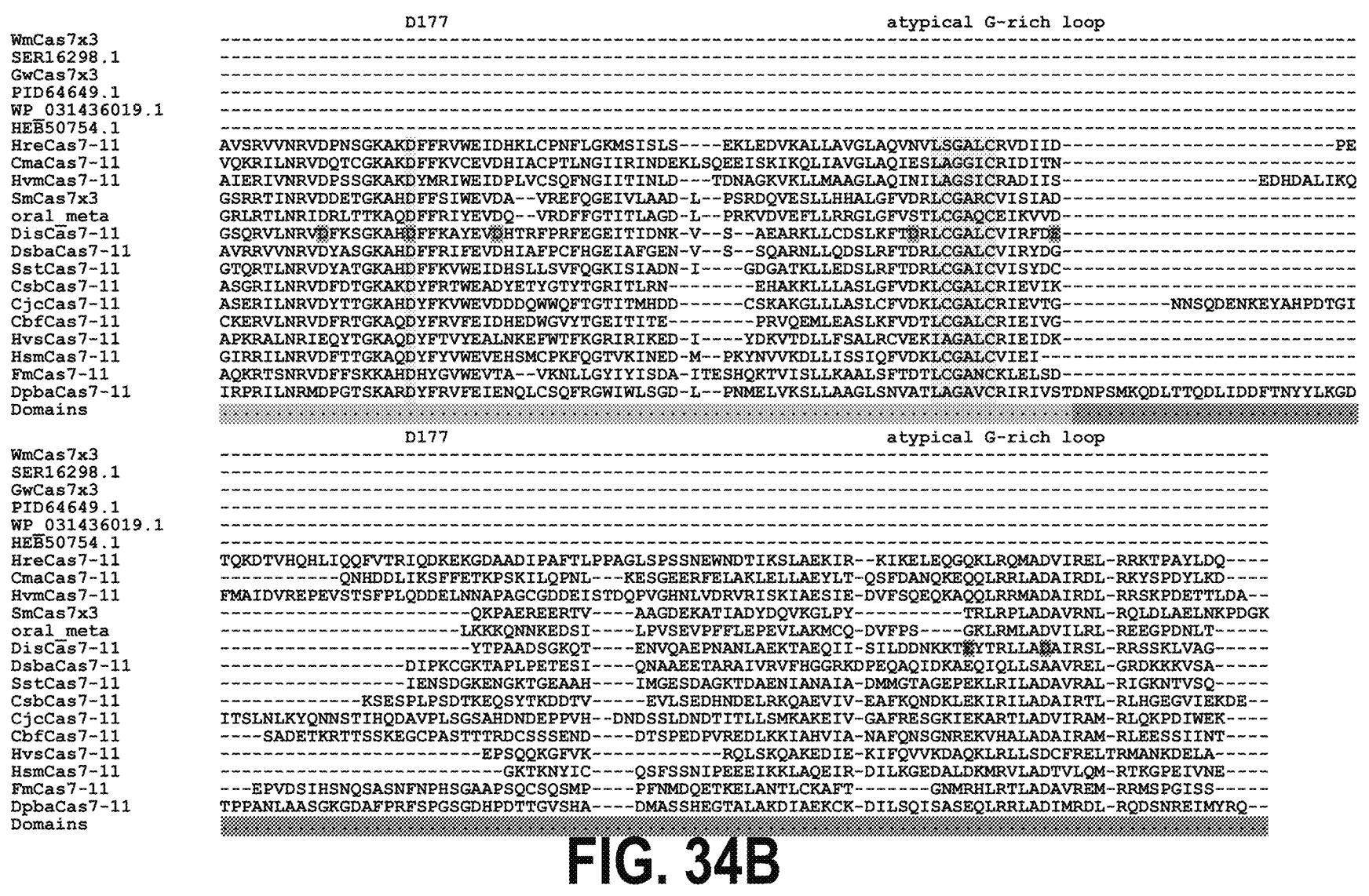
Figure 34D:
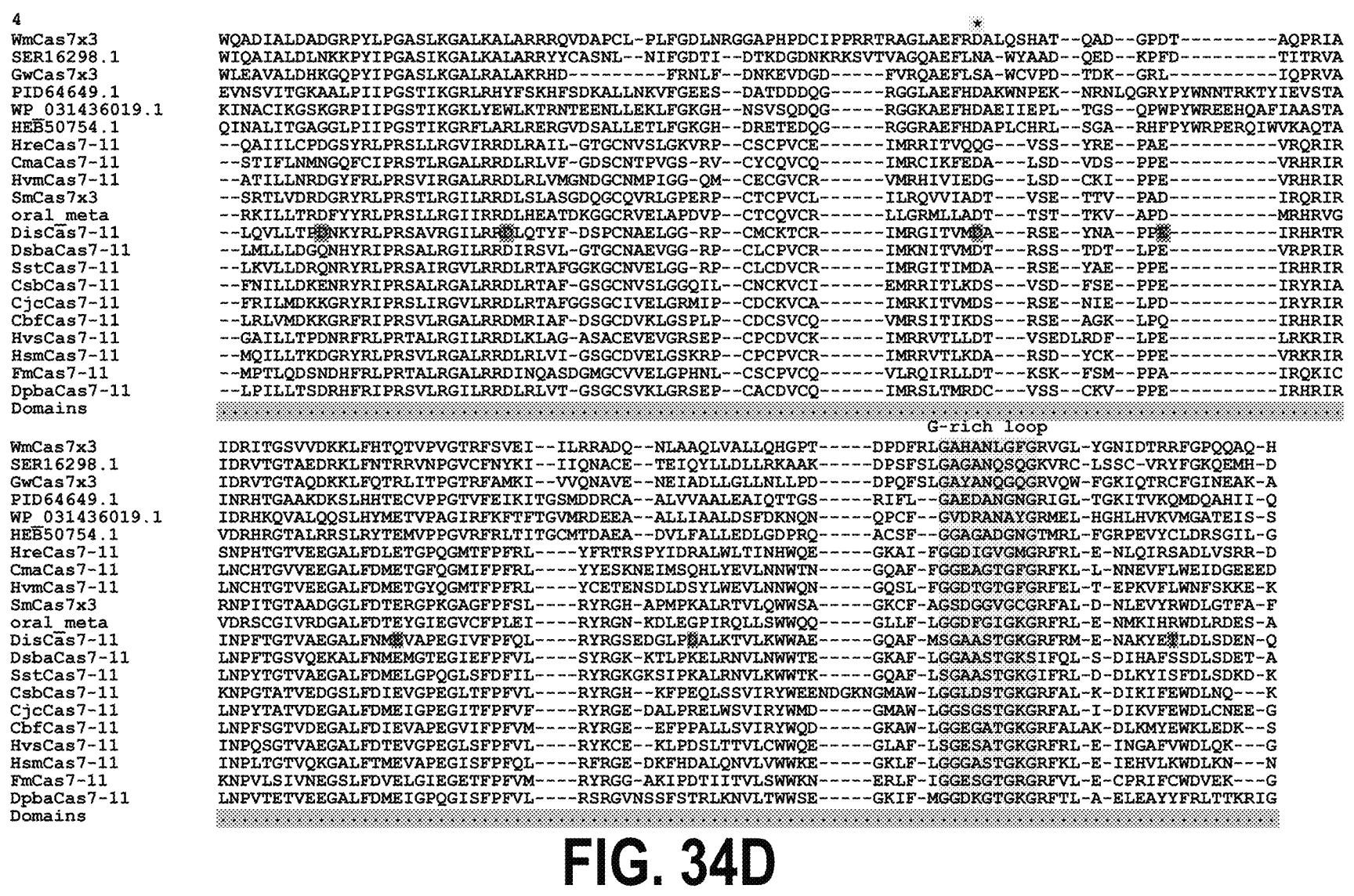
Figure 34E:
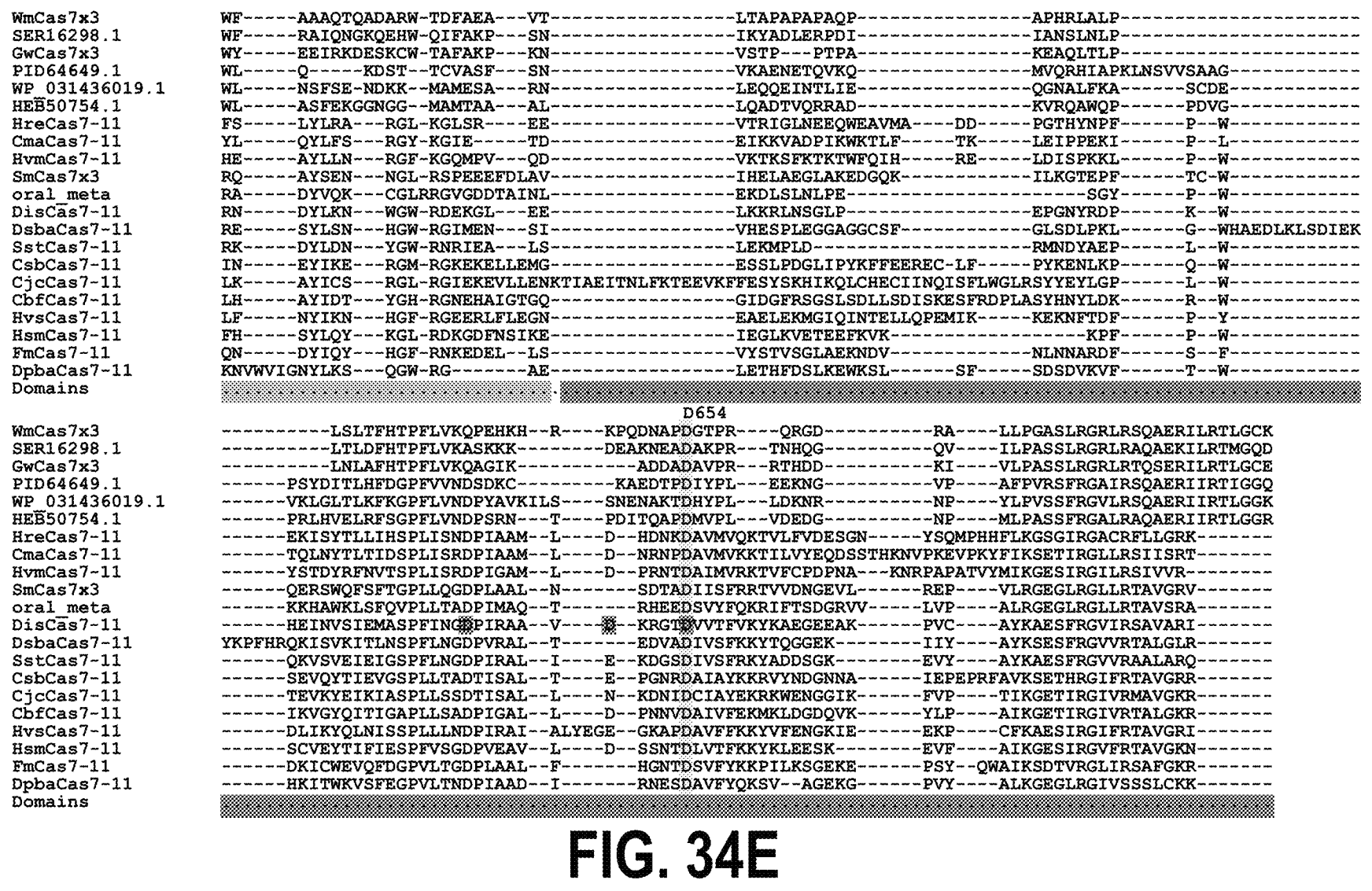
Figure 34G:
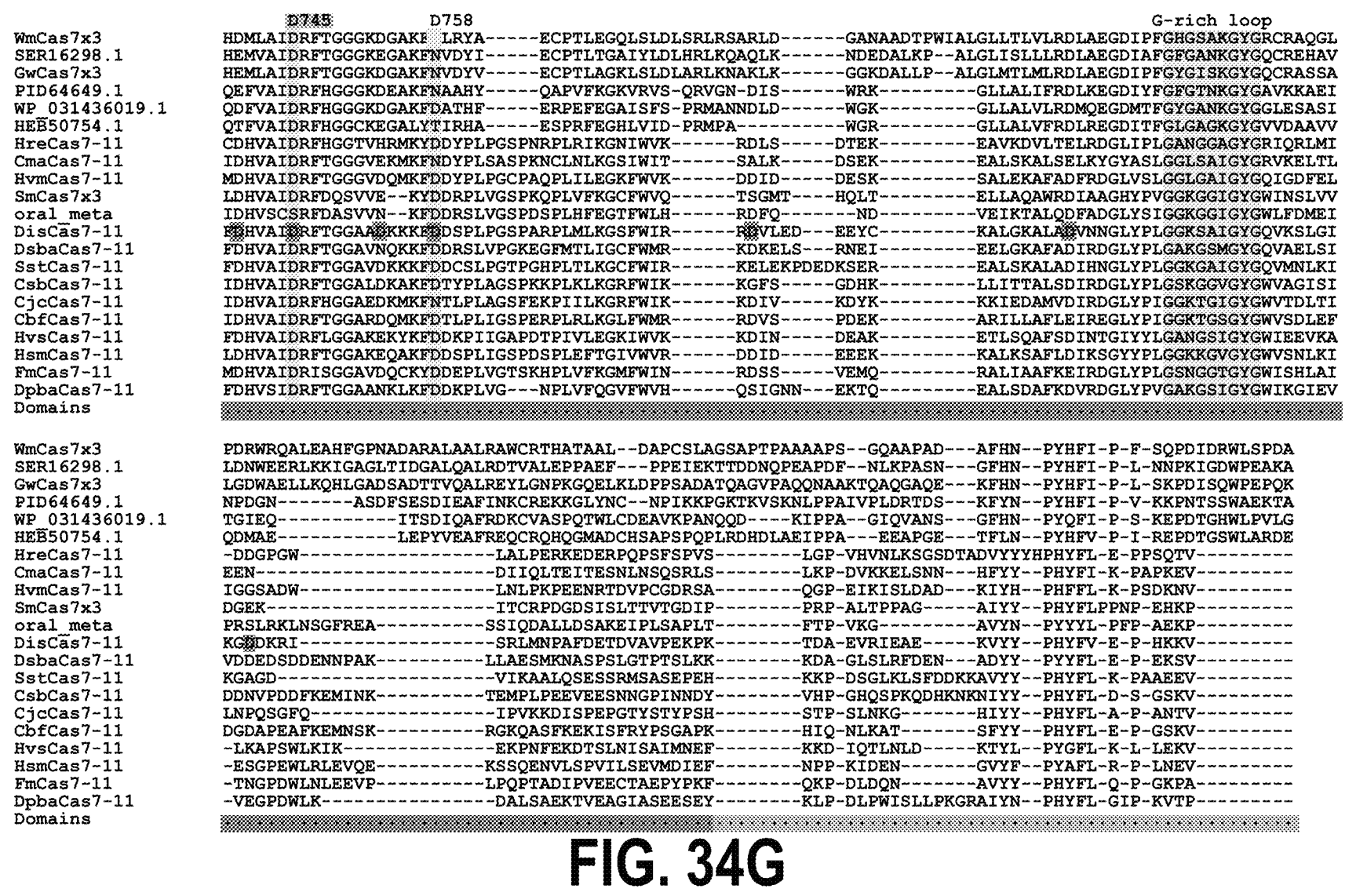
Figure 34H:
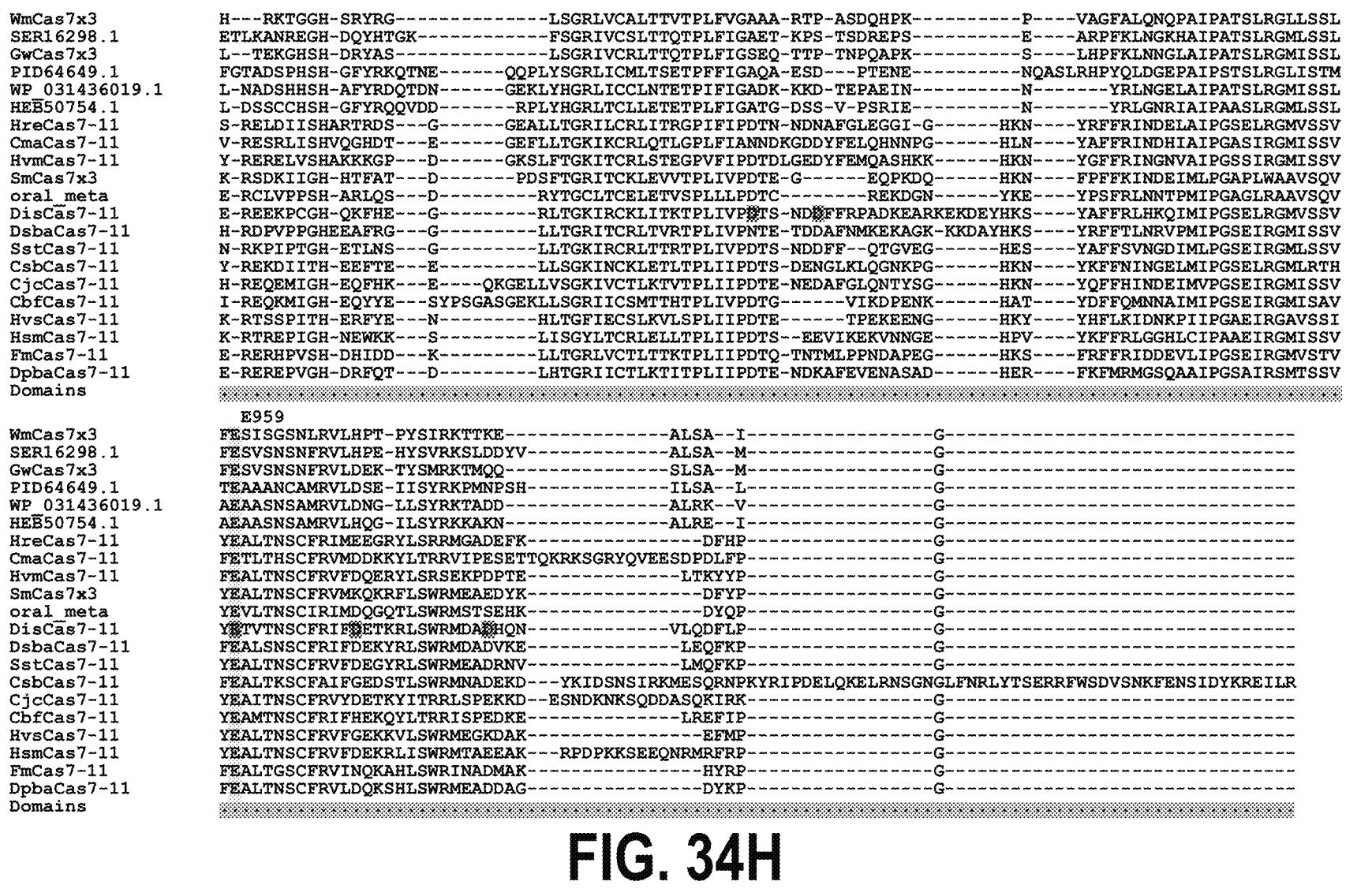
Figure 34I:
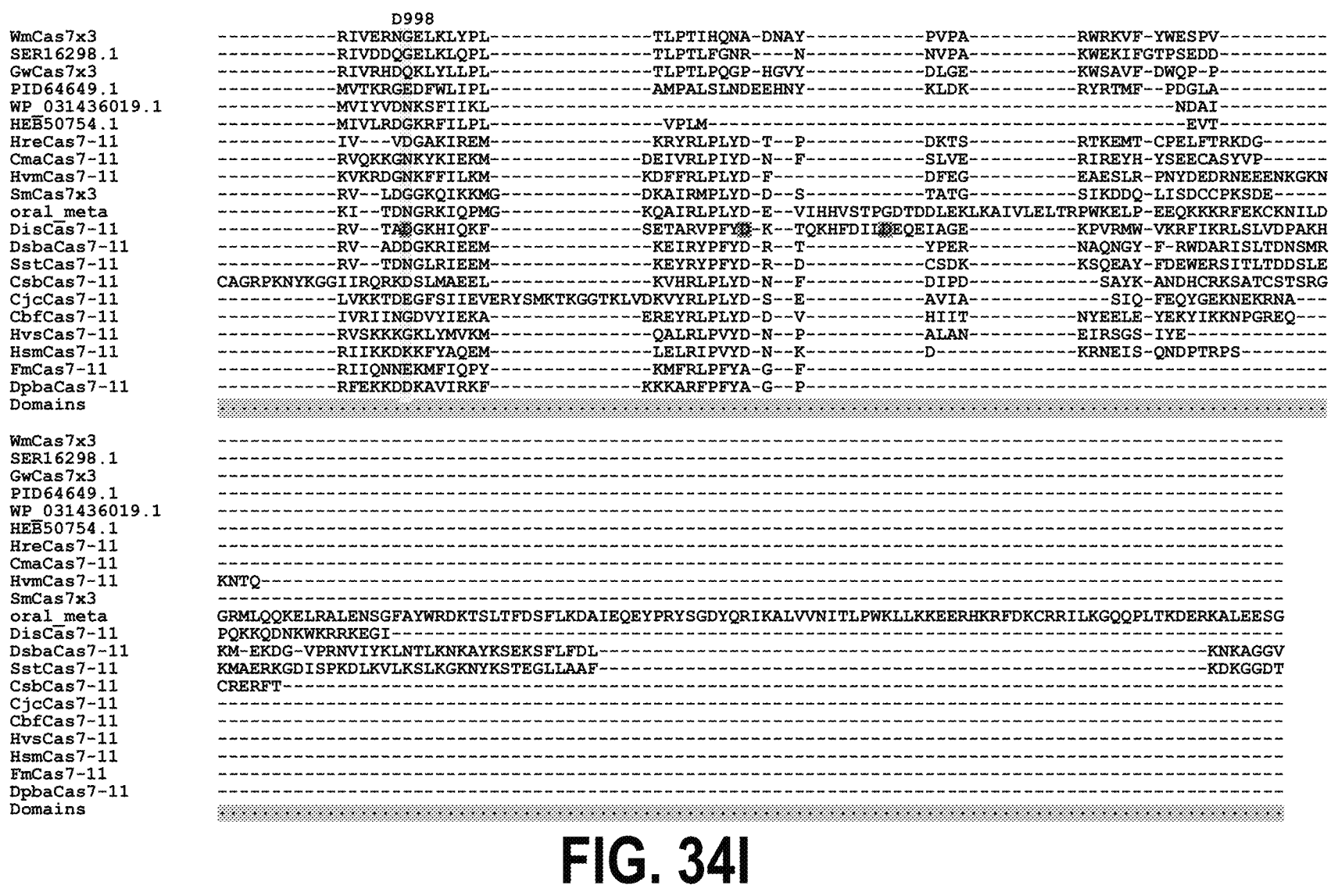
Figure 34J:
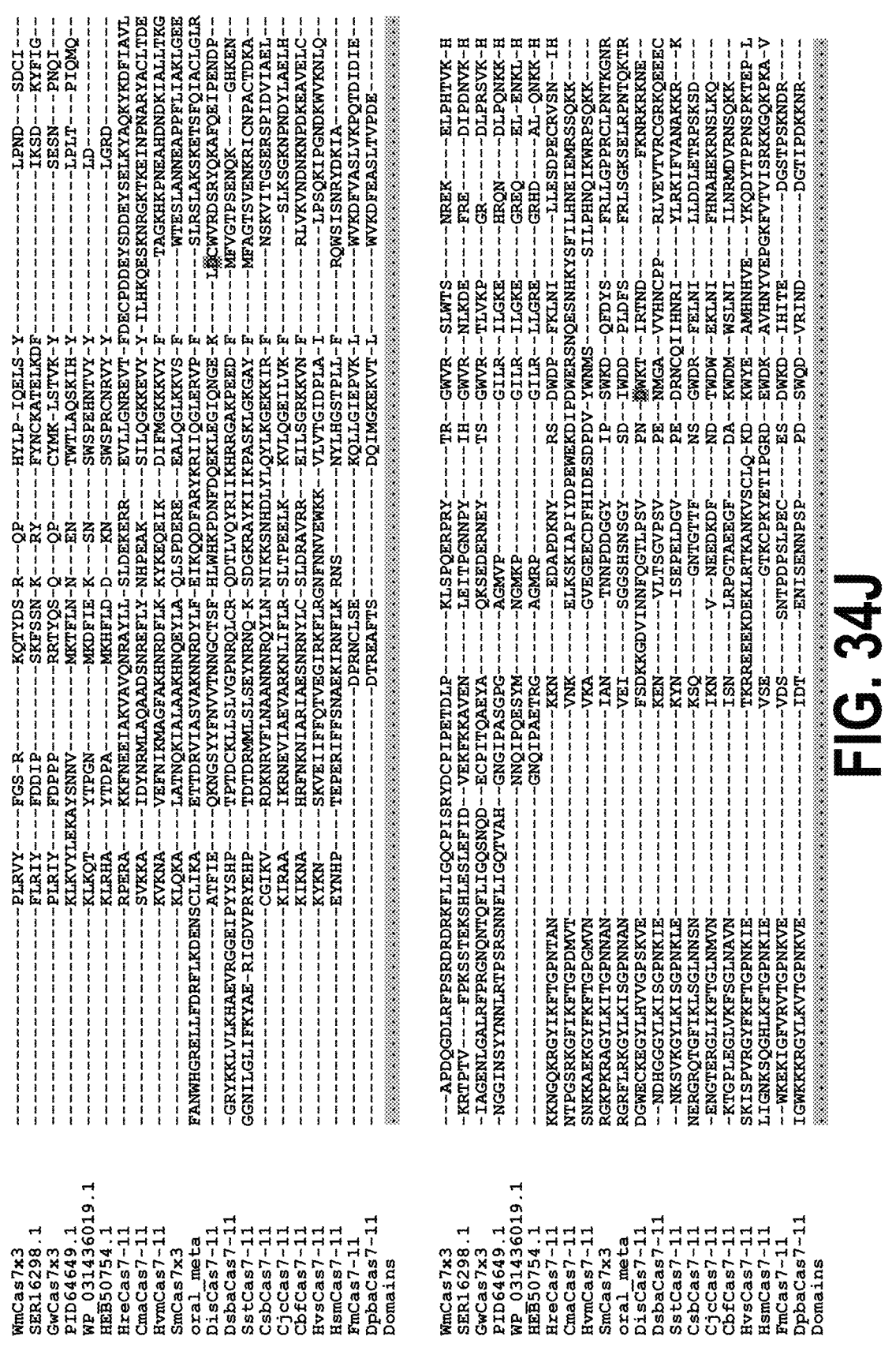
Figure 34L:
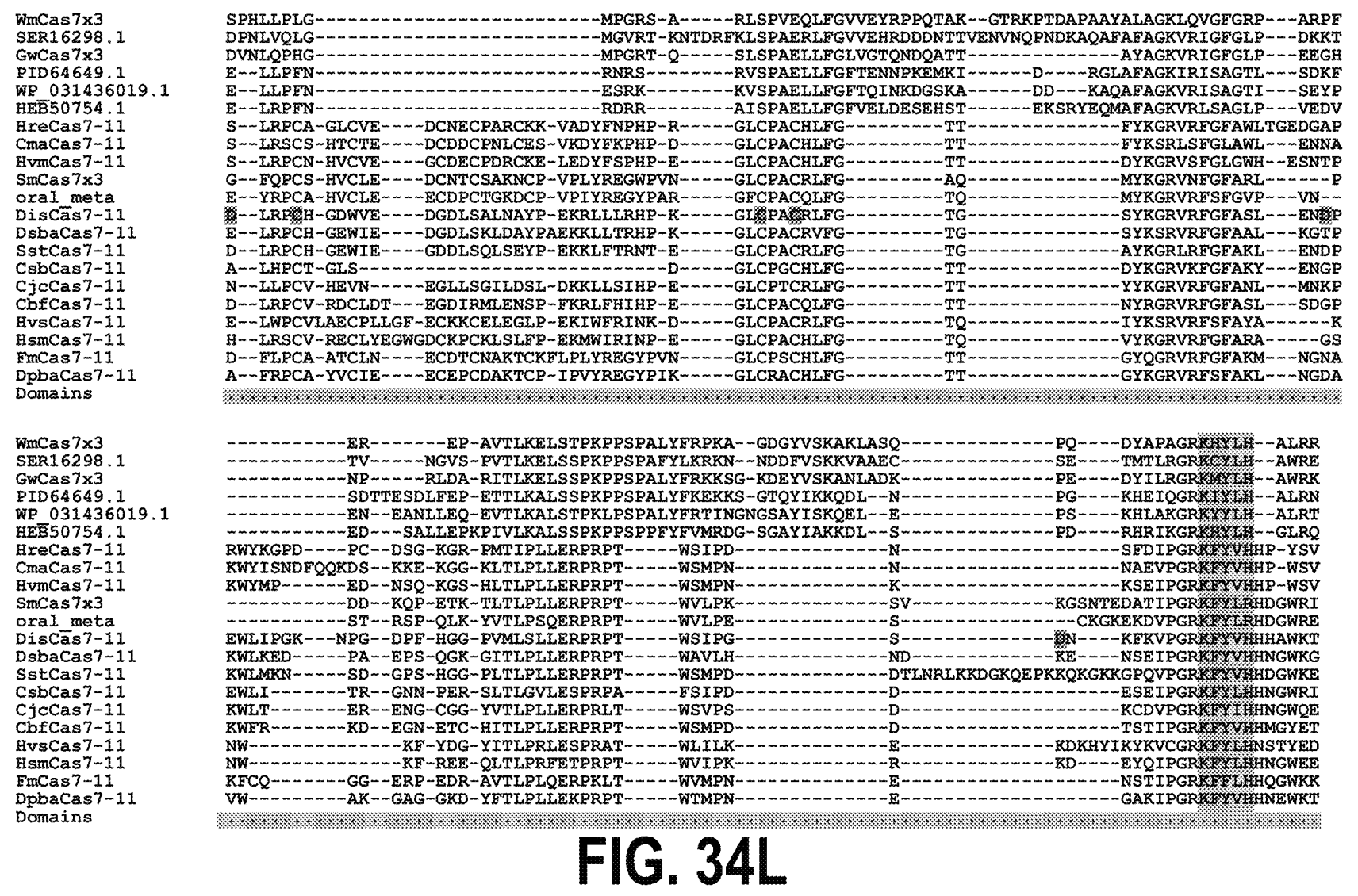

FIG. 34A shows domains and section 1 of sequence alignments of Cas nucleases according to embodiments of the present teachings. FIGS. 34A-O disclose SEQ ID NOS 611-631, respectively, in order of appearance;

FIG. 34B shows section 2 of sequence alignments of Cas nucleases according to embodiments of the present teachings. FIGS. 34A-O disclose SEQ ID NOS 611-631, respectively, in order of appearance;

FIG. 34C shows section 3 of sequence alignments of Cas nucleases according to embodiments of the present teachings. FIGS. 34A-O disclose SEQ ID NOS 611-631, respectively, in order of appearance;

FIG. 34D shows section 4 of sequence alignments of Cas nucleases according to embodiments of the present teachings. FIGS. 34A-O disclose SEQ ID NOS 611-631, respectively, in order of appearance;

FIG. 34E shows section 5 of sequence alignments of Cas nucleases according to embodiments of the present teachings. FIGS. 34A-O disclose SEQ ID NOS 611-631, respectively, in order of appearance;

FIG. 34F shows section 6 of sequence alignments of Cas nucleases according to embodiments of the present teachings. FIGS. 34A-O disclose SEQ ID NOS 611-631, respectively, in order of appearance;

FIG. 34G shows section 7 of sequence alignments of Cas nucleases according to embodiments of the present teachings. FIGS. 34A-O disclose SEQ ID NOS 611-631, respectively, in order of appearance;

FIG. 34H shows section 8 of sequence alignments of Cas nucleases according to embodiments of the present teachings. FIGS. 34A-O disclose SEQ ID NOS 611-631, respectively, in order of appearance;

FIG. 34I shows section 9 of sequence alignments of Cas nucleases according to embodiments of the present teachings. FIGS. 34A-O disclose SEQ ID NOS 611-631, respectively, in order of appearance;

FIG. 34J shows section 10 of sequence alignments of Cas nucleases according to embodiments of the present teachings. FIGS. 34A-O disclose SEQ ID NOS 611-631, respectively, in order of appearance;

FIG. 34K shows section 11 of sequence alignments of Cas nucleases according to embodiments of the present teachings. FIGS. 34A-O disclose SEQ ID NOS 611-631, respectively, in order of appearance;

FIG. 34L shows section 12 of sequence alignments of Cas nucleases according to embodiments of the present teachings. FIGS. 34A-O disclose SEQ ID NOS 611-631, respectively, in order of appearance;

FIG. 34M shows section 13 of sequence alignments of Cas nucleases according to embodiments of the present teachings. FIGS. 34A-O disclose SEQ ID NOS 611-631, respectively, in order of appearance;

FIG. 34N shows section 14 of sequence alignments of Cas nucleases according to embodiments of the present teachings. FIGS. 34A-O disclose SEQ ID NOS 611-631, respectively, in order of appearance; and FIG. 34O shows section 15 of sequence alignments of Cas nucleases according to embodiments of the present teachings. FIGS. 34A-O disclose SEQ ID NOS 611-631, respectively, in order of appearance.

DETAILED DESCRIPTION

It will be appreciated that for clarity, the following discussion will describe various aspects of embodiments of the applicant's teachings. It should be noted that the specific embodiments are not intended as an exhaustive description or as a limitation to the broader aspects discussed herein. One aspect described in conjunction with a particular embodiment is not necessarily limited to that embodiment and can be practiced with any other embodiment(s). Reference throughout this specification to "one embodiment", "an embodiment," "an example embodiment," means that a particular feature, structure or characteristic described in connection with the embodiment is included in at least one embodiment of the present invention. Thus, appearances of the phrases "in one embodiment," "in an embodiment," or "an example embodiment" in various places throughout this specification are not necessarily all referring to the same embodiment, but may. Furthermore, the particular features, structures or characteristics may be combined in any suitable manner, as would be apparent to a person skilled in the art from this disclosure, in one or more embodiments. Furthermore, while some embodiments described herein include some but not other features included in other embodiments, combinations of features of different embodiments are meant to be within the scope of the invention. For example, in the appended claims, any of the claimed embodiments can be used in any combination.

General Definitions

Unless defined otherwise, technical and scientific terms used herein have the same meaning as commonly understood by one of ordinary skill in the art to which this disclosure pertains. Definitions of common terms and techniques in molecular biology may be found in Molecular Cloning: A Laboratory Manual, 2nd edition (1989) (Sambrook, Fritsch, and Maniatis); Molecular Cloning: A Laboratory Manual, 4th edition (2012) (Green and Sambrook); Current Protocols in Molecular Biology (1987) (F. M. Ausubel et al. eds.); the series Methods in Enzymology (Academic Press, Inc.): PCR 2: A Practical Approach (1995) (M. J. MacPherson, B. D. Hames, and G. R. Taylor eds.): Antibodies, A Laboratory Manual (1988) (Harlow and Lane, eds.): Antibodies A Laboratory Manual, 2nd edition 2013 (E. A. Greenfield ed.); Animal Cell Culture (1987) (R. I. Freshney, ed.); Benjamin Lewin, Genes IX, published by Jones and Bartlet, 2008 (ISBN 0763752223); Kendrew et al. (eds.), The Encyclopedia of Molecular Biology, published by Blackwell Science Ltd., 1994 (ISBN 0632021829); Robert A. Meyers (ed.), Molecular Biology and Biotechnology: a Comprehensive Desk Reference, published by VCH Publishers, Inc., 1995 (ISBN 9780471185710); Singleton et al., Dictionary of Microbiology and Molecular Biology 2nd ed., J. Wiley & Sons (New York, N.Y. 1994), March, Advanced Organic Chemistry Reactions, Mechanisms and Structure 4th ed., John Wiley & Sons (New York, N.Y. 1992); and Marten H. Hofker and Jan van Deursen, Transgenic Mouse Methods and Protocols, 2nd edition (2011).

As used herein, the singular forms "a", "an," and "the" include both singular and plural referents unless the context clearly dictates otherwise.

The term "optional" or "optionally" means that the subsequent described event, circumstance or substituent may or may not occur, and that the description includes instances where the event or circumstance occurs and instances where it does not.

The recitation of numerical ranges by endpoints includes all numbers and fractions subsumed within the respective ranges, as well as the recited endpoints.

The terms "about" or "approximately" as used herein when referring to a measurable value such as a parameter, an amount, a temporal duration, and the like, are meant to encompass variations of and from the specified value, such as variations of +/−10% or less, +/−5% or less, +/−1% or less, +/−0.5% or less, and +/−0.1% or less of and from the specified value, insofar such variations are appropriate to perform in the disclosed invention. It is to be understood that the value to which the modifier "about" or "approximately" refers is itself also specifically, and preferably, disclosed.

Overview

The embodiments disclosed herein provide (non-naturally occurring or engineered) constructs, compositions, systems, and methods for site-directed RNA editing of RNA molecules. For example, the present invention provides (non-naturally occurring or engineered) methods for inhibiting intra and inter-cellular signaling pathways by modification of post-translational modification sites on select target RNA molecules. In certain example embodiments, the present invention provides (non-naturally occurring or engineered) methods for inhibiting intracellular phosphorylation of serine, threonine and tyrosine residues by editing the genetic codon of these amino acids by means of site-directed RNA editing or RNA molecules. Embodiments disclosed herein further provide methods of inhibiting pathological activation of cell signaling mediated by post-translational modifications, such as phosphorylation, which are involved in many diseases, including cancer, immunodeficiency, infectious diseases, inflammatory disorders and neurodegenerative disorders. The RNA-editing modification may be aimed at a single post-translational modification site of a single gene, but can also be multiplexed by targeting multiple sites on the same or different genes to increase efficacy. These approaches may be further combined with other treatments such as radiation, chemotherapy, targeted therapy based on antibodies or small molecules, and immunotherapy, which may have a synergistic effect.

The embodiments disclosed herein provide (non-naturally occurring or engineered) systems, constructs, and methods for targeted base editing. In general, the systems disclosed herein comprise a targeting component and a base editing component. The targeting component may function to specifically target the base editing component to a target nucleotide sequence in which one or more nucleotides are to be edited. The base editing component may then catalyze a chemical reaction to convert a first nucleotide in the target sequence to a second nucleotide. For example, the base editor may catalyze conversion of an adenine such that it is read as guanine by a cell's transcription or translation machinery, or vice versa. Likewise, the base editing component may catalyze conversion of cytidine to an uracil, or vice versa. In certain example embodiments, the base editor may be derived by starting with a known base editor, such as an adenine deaminase or cytidine deaminase, and modified using methods such as directed evolution to derive new functionalities. Directed evolution techniques are known in the art and may include those described in WO 2015/184016 "High-Throughput Assembly of Genetic Permutations."

Compositions and Systems

The present disclosure provides (non-naturally occurring or engineered) systems for editing a nucleic acid such as a gene or a product thereof (e.g., the encoded RNA or protein). In some embodiments, the systems may be an engineered, non-naturally occurring system suitable for modifying post-translational modification sites on proteins encoded by a target nucleic acid sequence. In certain cases, the target nucleic acid sequence is RNA, e.g., mRNA or a fragment thereof. In certain cases, the target nucleic acid sequence is DNA, e.g., a gene or a fragment thereof. In general, the system may comprise one or more of a catalytic inactive (dead) Cas protein (e.g., dead Cas7-11), a nucleotide deaminase protein or catalytic domain thereof, and a guide molecule. In certain examples, the nucleotide deaminase protein may be an adenosine deaminase. In certain examples, the nucleotide deaminase protein may be a cytidine deaminase. The guide sequence may be designed to have a degree of complementarity with a target sequence at one or more codons comprising an adenine or cytidine and that is post-translationally modified.

CRISPR-Cas

Some embodiments disclosed herein are directed to CRISPR-Cas (clustered regularly interspaced short palindromic repeats associated proteins) systems. In the conflict between bacterial hosts and their associated viruses, CRISPR-Cas systems provide an adaptive defense mechanism that utilizes programmed immune memory. CRISPR-Cas systems provide their defense through three stages: adaptation, the integration of short nucleic acid sequences into the CRISPR array that serves as memory of past infections; expression, the transcription of the CRISPR array into a pre-crRNA (CRISPR RNA) transcript and processing of the pre-crRNA into functional crRNA species targeting foreign nucleic acids; and interference, the programming of CRISPR effectors by crRNA to cleave nucleic acid of foreign threats. Across all CRISPR-Cas systems, these fundamental stages display enormous variation, including the identity of the target nucleic acid (either RNA, DNA, or both) and the diverse domains and proteins involved in the effector ribonucleoprotein complex of the system.

CRISPR-Cas systems can be broadly split into two classes based on the architecture of the effector modules involved in pre-crRNA processing and interference. Class 1 systems have multi-subunit effector complexes composed of many proteins, whereas Class 2 systems rely on single-effector proteins with multi-domain capabilities for crRNA binding and interference; Class 2 effectors often provide pre-crRNA processing activity as well. Class 1 systems contain 3 types (type I, III, and IV) and 33 subtypes, including the RNA and DNA targeting type III-systems. Class 2 CRISPR families encompass 3 types (type II, V, and VI) and 17 subtypes of systems, including the RNA-guided DNases Cas9 and Cas12 and the RNA-guided RNase Cas13. Continual sequencing of novel bacterial genomes and metagenomes uncovers new diversity of CRISPR-Cas systems and their evolutionary relationships, necessitating experimental work that reveals the function of these systems and develops them into new tools.

Among the currently known CRISPR-Cas systems, only the type III and type VI systems have been demonstrated to bind and target RNA, and these two systems have substantially different properties, the most distinguishing being their membership in Class 1 and Class 2, respectively. Characterized subtypes of type III, which span type III-A, B, and C systems, target both RNA and DNA species through an effector complex containing multiple Cas7 (Csm3/5 or Cmr1/4/6) RNA nuclease units in association with a single Cas10 (Csm1 or Cmr2) DNA nuclease. The RNA nuclease activity of Cas7 is mediated through acidic residues in the repeat-associated mysterious proteins (RAMP) domains, which cut at stereotyped intervals in the guide:target duplex. Type III systems also have a target restriction, and cannot efficiently target protospacers in vivo if there is extended homology between the 5' "tag" of the crRNA and the "anti-tag" 3' of the protospacer in the target, although this binding does not block RNA cleavage in vitro. In type III systems, pre-crRNA processing is carried out by either host factors or the associated Cas6 family protein, which can physically complex with the effector machinery.

In contrast to type III systems, type VI systems contain a single CRISPR effector Cas13 that can only effect RNA interference, mediated through basic catalytic residues of dual HEPN domains. This interference requires a protospacer flanking sequence (PFS), although the influence of the PFS varies between orthologs and families. Importantly, the RNA cleavage activity of Cas13, once triggered by crRNA:target duplex formation, is indiscriminate, and activated Cas13 enzymes will cleave other RNA species in vitro, in bacterial hosts, and mammalian cells. This activity, termed the collateral effect, has been applied to CRISPR-based nucleic acid detection technologies. In addition to the RNA interference activity, the Cas13 family members contain pre-crRNA processing activity. Just as single-effector DNA targeting systems have given rise to numerous genome editing applications, Cas13 family members have been applied to a suite of RNA-targeting technologies in both bacterial and eukaryotic cells, including RNA knockdown, RNA editing, RNA tracking, epitranscriptome editing, translational upregulation, epi-transcriptomic reading and writing via N6-Methyladenosine, and isoform modulation.

The novel type III-E system was recently identified from genomes of 8 bacterial species and is characterized as a fusion of several Cas7 proteins and a putative Cas11 (Csm2)-like small subunit. The domain composition suggests the fusion of multiple type III effector module domains involved in crRNA binding into a single protein effector that is predicted to process pre-crRNA given its homology with Cas5 (Csm4) and conserved aspartates. The lack of other putative effector nucleases in these CRISPR loci raise the additional possibility that this fusion protein is capable of crRNA-directed RNA cleavage. If so, this system would blur the distinction of Class 1 and Class 2 systems, as it would have domains homologous to other Class 1 systems, but possess a single effector module characteristic of Class 2 systems. Beyond the single effector module present in all subtype III-E loci, a majority of type III-E family members contain a putative ancillary gene with a CHAT domain, which is a caspase family protease associated with programmed cell death (PCD), suggesting involvement of PCD-mediated antiviral strategies, as has been observed with type III and VI systems.

Figure 1A:
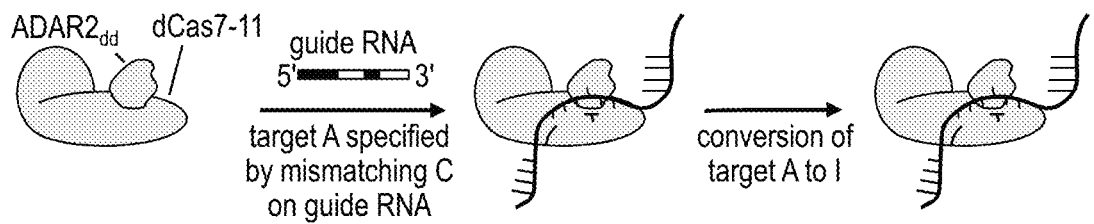
FIG. 1A is a schematic representation of RNA editing via dDisCas7-11a-NES-ADAR2 fusions that are programmed to target a specific adenosine via a cytidine mismatch for A to I editing in the guide:target RNA duplex according to embodiments of the present teachings.
Figure 1B:
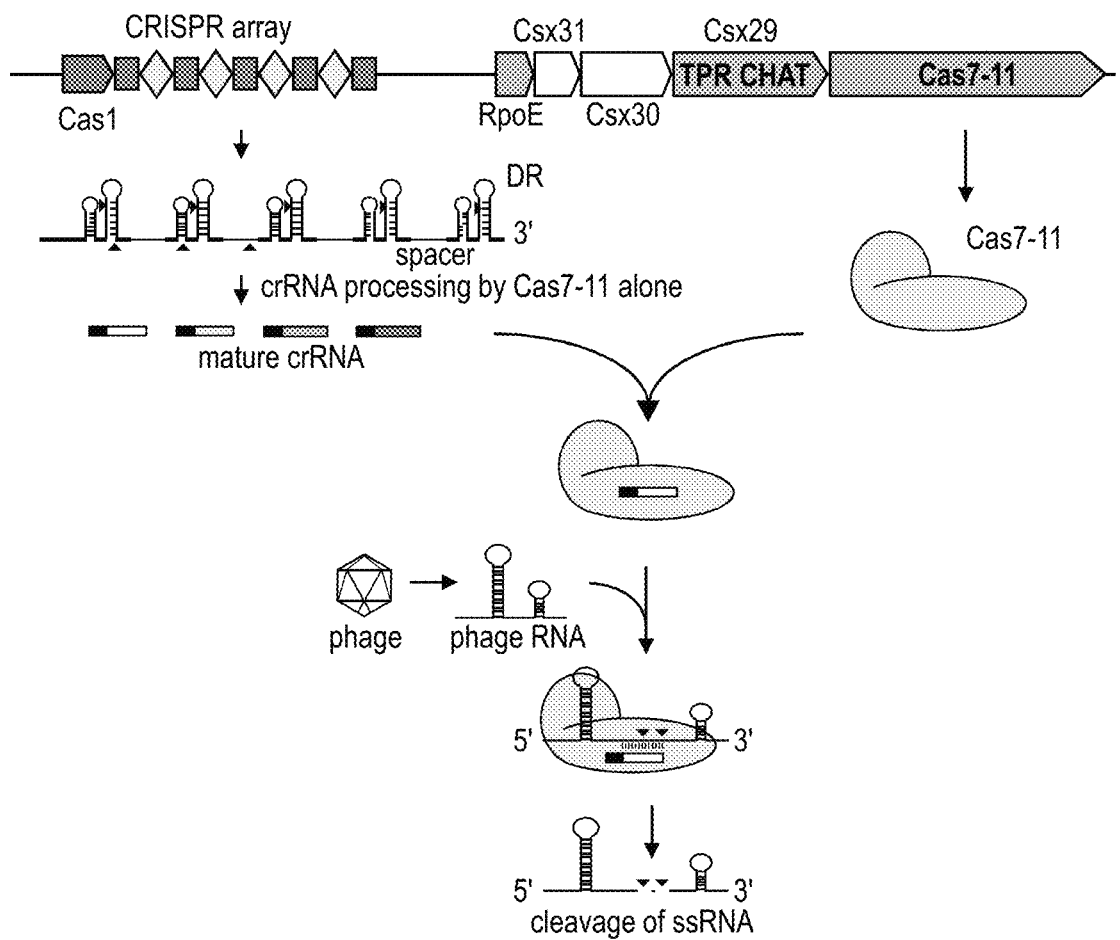
FIG. 1B is a schematic of Cas7-11 expression, processing, and interference against ssRNA viruses and other ssRNA targets according to embodiments of the present teachings.

Type III-E system associated effector, interchangeably termed Cas15 and Cas7-11 herein, is a programmable RNase (FIGS. 1A-1D). This system can provide defense against RNA phage and be programmed to target exogenous mRNA species when expressed heterologously in bacteria. Orthologs of Cas7-11 are capable of both processing of pre-crRNA and crRNA-directed cleavage of RNA targets, and determine catalytic residues underlying programmed RNA cleavage. A direct evolutionary path of Cas7-11 can be traced from individual Cas7 and Cas11 effector proteins of subtype III-D1 variant, through an intermediate, a partially fused effector Cas7×3 of the subtype III-D2 variant, to the singe-effector architecture of subtype III-E that is so far unique among the Class 1 CRISPR-Cas systems (FIG. 1D). Cas7-11 most likely originated from two type III-D variants. Three Cas7 domains (domains 3, 4 and 5) are derived from subtype III-D2 that contains a the Cas7×3 effector protein along with Cas10 and another Cas7-like domain fused to a Cas5-like domain. The origin of the N-terminal Cas7 and putative Cas11 domain of Cas7-11 is most likely derived from a III-D1 variant, where both genes are stand-alone.

Cas7-11 differs substantially from Cas13, in terms of both domain organization and activity (FIG. 1C). Cas13 RNA cleavage is enacted by dual HEPN domains with basic catalytic residues, and this cleavage, once triggered, is indiscriminate. In contrast, Cas7-11 utilizes at least two of four Cas7-like domains with acidic catalytic residues to generate stereotyped cleavage at the target binding site in cis. Furthermore, Cas13 targeting is restricted by the requirement for a PFS, which Cas7-11 does not require, and the DR of Cas7-11-associated crRNA is substantially shorter. Because of these unique features, Cas7-11 may have distinct advantages for RNA targeting and transcriptome engineering biotechnology applications.

Regulation of interference by accessory proteins has been observed in both type III and type VI systems, and other proteins in the *D. ishimotonii* type III-E locus can regulate activity of DisCas7-11a. Notably, TPR-CHAT had a strong inhibitory effect on DisCas7-11a phage interference, raising the possibility that unrestricted DisCas7-11a activity could be detrimental for the host. Alternatively, as TPR-CHAT is a caspase family protease associated with programmed cell death (PCD), it is possible that TPR-CHAT is activated by DisCas7-11a and leads to host death, which could mimic death due to phage in these assays. TPR-CHAT caspase activity could be activated by DisCas7-11a and cause PCD through general proteolysis, analogous to PCD triggered by Cas13 collateral activity.

Similar to Class 2 CRISPR effectors such as Cas9, Cas12, and Cas13, Cas7-11 is highly active in mammalian cells, with substantial knockdown activity on both reporter and endogenous transcripts. Moreover, via inactivation of active sites through mutagenesis, the catalytically inactive dCas7-11 enzyme can be used to recruit ADAR2DD for efficient site-specific A-to-I editing on transcripts. These applications establish Cas7-11 as the basis for an RNA-targeting toolbox that has several benefits compared to Cas13, including the lack of sequence preferences and collateral activity, the latter of which has been shown to induce toxicity in certain cell types. A Cas7-11 toolbox may serve as the basis for multiple RNA technologies, including RNA knockdown, RNA editing, translation modulation, RNA recruitment, RNA tracking, splicing control, RNA stabilization, and potentially even diagnostics.

AD-Functionalized CRISPR Systems

In some embodiments, the systems may be AD-functionalized CRISPR system. The term "AD-functionalized CRISPR system" as used here refers to a nucleic acid targeting and editing system comprising (a) a CRISPR-Cas protein, more particularly a Cas7-11 protein which is catalytically active or inactive; (b) a guide molecule which comprises a guide sequence; and (c) an adenosine deaminase (AD) protein or catalytic domain thereof; wherein the adenosine deaminase protein or catalytic domain thereof is covalently or non-covalently linked to the CRISPR-Cas protein or the guide molecule or is adapted to link thereto after delivery; wherein the guide sequence is substantially complementary to the target sequence but comprises a non-pairing C corresponding to the A being targeted for deamination, resulting in an A-C mismatch in an RNA duplex formed by the guide sequence and the target sequence. In some embodiments, the CRISPR-Cas protein and/or the adenosine deaminase comprise one or more heterologous nuclear export signal(s) (NES(s)) or nuclear localization signal(s) (NLS(s)). For application in eukaryotic cells, the CRISPR-Cas protein and/or the adenosine deaminase can be NES-tagged or NLS-tagged.

One skilled in the art would appreciate that the components (a), (b) and (c) can be delivered to the cell as a ribonucleoprotein complex. The ribonucleoprotein complex can be delivered via one or more lipid nanoparticles. One skilled in the art would appreciate that the components (a), (b) and (c) can be delivered to the cell as one or more RNA molecules, such as one or more guide RNAs and one or more mRNA molecules encoding the CRISPR-Cas protein, the adenosine deaminase protein, and optionally the adaptor protein. The RNA molecules can be delivered via one or more lipid nanoparticles. One skilled in the art would appreciate that the components (a), (b) and (c) can be delivered to the cell as one or more DNA molecules. The one or more DNA molecules can be comprised within one or more vectors such as viral vectors (e.g., AAV). The one or more DNA molecules can comprise one or more regulatory elements operably configured to express the CRISPR-Cas protein, the guide molecule, and the adenosine deaminase protein or catalytic domain thereof, optionally wherein the one or more regulatory elements comprise inducible promoters.

In some embodiments, the CRISPR-Cas protein is a dead Cas7-11. In some embodiments, the dead Cas7-11 comprises one or more mutations in the Cas7-like domains, including D429A and D654A as well as many other mutations (see table 1).

In some embodiments, the guide molecule is capable of hybridizing with a target sequence comprising the Adenine to be deaminated within an RNA sequence to form an RNA duplex which comprises a non-pairing Cytosine opposite to said Adenine. Upon RNA duplex formation, the guide molecule forms a complex with the Cas7-11 protein and directs the complex to bind the RNA polynucleotide at the target RNA sequence of interest. Details on the aspect of the guide of the AD-functionalized CRISPR-Cas system are provided herein below.

In at least a first design, the AD-functionalized CRISPR system comprises: (a) an adenosine deaminase fused or linked to a CRISPR-Cas protein, wherein the CRISPR-Cas protein is catalytically inactive; and (b) a guide molecule comprising a guide sequence designed to introduce an A-C mismatch in an RNA duplex formed between the guide sequence and the target sequence. In some embodiments, the CRISPR-Cas protein and/or the adenosine deaminase can be NLS-tagged, on either the N- or C-terminus or both.

In at least a second design, the AD-functionalized CRISPR system comprises: (a) a CRISPR-Cas protein that is catalytically inactive; (b) a guide molecule comprising a guide sequence designed to introduce an A-C mismatch in an RNA duplex formed between the guide sequence and the target sequence, and an aptamer sequence (e.g., MS2 RNA motif or PP7 RNA motif) capable of binding to an adaptor protein (e.g., MS2 coating protein or PP7 coat protein); and (c) an adenosine deaminase fused or linked to an adaptor protein, wherein the binding of the aptamer and the adaptor protein recruits the adenosine deaminase to the RNA duplex formed between the guide sequence and the target sequence for targeted deamination at the A of the A-C mismatch. In some embodiments, the adaptor protein and/or the adenosine deaminase can be NLS-tagged, on either the N- or C-terminus or both. The CRISPR-Cas protein can also be NLS-tagged. The CRISPR-Cas protein can also be NLS-tagged.

The use of different aptamers and corresponding adaptor proteins also allows orthogonal gene editing to be implemented. In one example in which adenosine deaminase are used in combination with cytidine deaminase for orthogonal gene editing/deamination, sgRNA targeting different loci are modified with distinct RNA loops in order to recruit MS2-adenosine deaminase and PP7-cytidine deaminase (or PP7-adenosine deaminase and MS2-cytidine deaminase), respectively, resulting in orthogonal deamination of A or C at the target loci of interested, respectively. PP7 is the RNA-binding coat protein of the bacteriophage *Pseudomonas*. Like MS2, it binds a specific RNA sequence and secondary structure. The PP7 RNA-recognition motif is distinct from that of MS2. Consequently, PP7 and MS2 can be multiplexed to mediate distinct effects at different genomic loci simultaneously. For example, an sgRNA targeting locus A can be modified with MS2 loops, recruiting MS2-adenosine deaminase, while another sgRNA targeting locus B can be modified with PP7 loops, recruiting PP7-cytidine deaminase. In the same cell, orthogonal, locus-specific modifications are thus realized. This principle can be extended to incorporate other orthogonal RNA-binding proteins.

In at least a third design, the AD-functionalized CRISPR system comprises: (a) an adenosine deaminase inserted into an internal loop or unstructured region of a CRISPR-Cas protein, wherein the CRISPR-Cas protein is catalytically inactive or a nickase; and (b) a guide molecule comprising a guide sequence designed to introduce an A-C mismatch in an RNA duplex formed between the guide sequence and the target sequence.

The AD-functionalized CRISPR system described herein can be used to target a specific Adenine within an RNA polynucleotide sequence for deamination. For example, the guide molecule can form a complex with the CRISPR-Cas protein and directs the complex to bind a target RNA sequence in the RNA polynucleotide of interest. Because the guide sequence is designed to have a non-pairing C, the RNA duplex formed between the guide sequence and the target sequence comprises an A-C mismatch, which directs the adenosine deaminase to contact and deaminate the A opposite to the non-pairing C, converting it to an Inosine (I). Since Inosine (I) base pairs with C and functions like G in cellular processes, the targeted deamination of A described herein are useful for correction of undesirable G-A and C-T mutations, as well as for obtaining desirable A-G and T-C mutations.

In some embodiments, the AD-functionalized CRISPR system is used for targeted deamination in an RNA polynucleotide molecule in vitro. In some embodiments, the AD-functionalized CRISPR system is used for targeted deamination in a DNA molecule and/or RNA molecule within a cell. The cell can be an eukaryotic cell such as a bacteria or cyanobacteria. The cell can be a eukaryotic cell, such as an animal cell, a mammalian cell, a human, or a plant cell.

The invention also relates to a (non-naturally occurring or engineered) method for treating or preventing a disease by the targeted deamination using the AD-functionalized CRISPR system, wherein the deamination of the A, which remedies a disease caused by transcripts containing a pathogenic G→A or C→T point mutation. Examples of disease that can be treated or prevented with the present invention include cancer, Meier-Gorlin syndrome, Seckel syndrome 4, Joubert syndrome 5, Leber congenital amaurosis 10; Charcot-Marie-Tooth disease, type 2; Charcot-Marie-Tooth disease, type 2; Usher syndrome, type 2C; Spinocerebellar ataxia 28; Spinocerebellar ataxia 28; Spinocerebellar ataxia 28; Long QT syndrome 2; Sjogren-Larsson syndrome; Hereditary fructosuria; Hereditary fructosuria; Neuroblastoma; Neuroblastoma; Kallmann syndrome 1; Kallmann syndrome 1; Kallmann syndrome 1; Metachromatic leukodystrophy.

AD-functionalized CRISPR system for RNA editing can be used for translation upregulation or downregulation, improving RNA stability and diagnostics. For example, for application in diagnostics, TPR-Chat is an accessory protein that interacts with Cas7-11 interference. Cas7-11 can activate TPR-Chat caspase activity which can then activate a reporter. While this can be used for inducing cell death based on RNA detection (e.g. in cancer cells), it also can be useful for general RNA diagnostics (i.e. molecular diagnostics for bacteria, viruses, and derivatives thereof) in samples. Furthermore, Cas7-11 can re-constitute a split protein like GFP on a specific transcript.

AD-functionalized CRISPR system for RNA editing can be used to treat or prevent premature termination diseases. Pre-termination diseases are characterized by mutations in early stop codons, either through single nucleotide polymorphisms that introduce termination, indels that change the translational frame of the protein and generate new stop codons, or alternative splicing that preferentially introduces exons that have early termination. By removing stop codons generated in these ways via A to I editing, RNA editing with ADAR could rescue diseases involving premature termination. In cases where SNPs are not G to A, but generate nonsense mutations, clinical benefit could be derived from changing nonsense mutations into missense mutations.

AD-functionalized CRISPR system for RNA editing can be used to change fertility mutations without germline editing. One advantage of RNA editing over DNA editing is in cases of SNPs affecting fertility, where correction with genome editing would necessarily result in germline editing, with potential ethical or safety implications. RNA editing could correct these mutations without permanent effects on the genome, thereby circumventing these issues.

AD-functionalized CRISPR system for RNA editing can be used for splicing alteration. Pre-mRNA requires specific splice donor and acceptor sequences in order to undergo processing by the spliceosome. Splice acceptor sites contain an invariant AG sequence that is necessary for acceptance of the attack by the splice donor sequence and intron removal. By targeting Cas7-11-ADAR fusions to pre-mRNA and editing AG splice acceptor sites to IG, it can be possible to inactivate the splice acceptor site, resulting in skipping of the downstream exon. This approach to splicing alteration has advantages over the current method of exon skipping with chemically modified anti-sense oligos. Cas7-11-ADAR can be genetically encoded, allowing for long-term exon skipping. Additionally, Cas7-11-ADAR creates a mutation to promote skipping, which can be more robust than masking of the splice donor/acceptor site by a double stranded RNA, as is done with anti-sense oligos.

AD-functionalized CRISPR system for RNA editing can be used to alter neoantigens. Neoantigens in cancer are novel antigens that are expressed in tumor cells due to mutations that arise because of defective mismatch repair. Engineering T cells against neoantigens is advantageous because the T cells will have no off-target activity and thus toxicity since the antigens are only expressed in the tumor cells. With RNA base editors, the Cas7-11-ADAR fusions can be targeted to cancer cells to introduce mutations in transcripts that would introduce amino acid changes and new antigens that can be targeted using chimeric antigen receptor T cells. This approach is better than DNA base editors because it is transient and thus the risk of editing non-tumor cells permanently due to off-target delivery is minimal.

AD-functionalized CRISPR system for RNA editing can be used to change microRNA targets for tumor suppressors. ADAR naturally edits mRNA to generate or remove microRNA targets, thereby modulating expression. Programmable RNA editing can be used to up- or down-regulate microRNA targets via altering of targeting regions. Additionally, microRNAs themselves are natural substrates for ADAR, and programmable RNA editing of micoRNAs can reduce or enhance the function on their corresponding targets.

AD-functionalized CRISPR system for RNA editing can be used to make multiple edits along a region. The Cas7-11-ADAR fusions can be precisely targeted to edit specific adenosines by introducing a mismatch in the guide region across from the desired adenosine target and creating a bubble that is favorable for A-to-I editing. By introducing multiple of these mismatches across different adenosine sites in the guide/target duplex, it can be possible to introduce multiple mutations at once.

AD-functionalized CRISPR system for RNA editing can be used for the reversal of TAA (double A to G) for PTC. Many diseases that involve pretermination codon changes involve a TAA stop codon, which would require A-to-I changes to correct rather than the TAG or TGA stop codons which only need one A-to-I edit. Two approaches can be used to reverse the TAA stop codon. (1) As described in the previous section, two mismatches can be introduced in the guide against the two adenosines in the TAA codon. (2) A two-guide array can be used to convert each of the adenosines to inosine sequentially. The first guide in the array can contain a mutation against the first adenosine and the second guide can then have complementarity to this change and have a mismatch against the second adenosine in the stop codon.

AD-functionalized CRISPR system for RNA editing can be used to treat or prevent cancer (GOF, LOF mutation reversal). Many oncogenic changes in cancer involve G to A mutations that introduce gain of function or loss of function phenotypes to the mutated proteins. The RNA base editors are well positioned to correct these changes and reduce oncogenesis.

RNA editing with ADAR can be used for the design of new base preferences. Current ADAR1/2 proteins have been found to have surrounding base preferences for catalytic activity, which may pose constraints for certain applications. Rational mutagenesis or directed evolution of ADAR variants with altered or relaxed base preferences can increase the versatility of programmable RNA editing.

AD-functionalized CRISPR system for RNA editing can comprise ADAR mutants with increased activity in human cells. Although ADAR mutants with altered activity in vitro or in yeast have been previously reported, screening or rational design of mutants with increased activity in the context of human cells can improve the efficiency or specificity of ADAR-based programmable RNA editing constructs.

AD-functionalized CRISPR system for RNA editing can be used in biological applications of inosine generation. The RNA editing with ADAR generates inosine, which, when occurring multiple times in a transcript, can interact with endogenous biological pathways to increase inflammation in cells and tissues. Generation of multiple inosine bases can increase inflammation, especially in cells where inflammation can lead to clearance. Additional inosine generation could also be used to destabilize transcripts.

AD-functionalized CRISPR system for RNA editing can be used in removing upstream start codons to promote protein expression of downstream ORF (ATG mutation). Anti-sense oligos have been used for blocking upstream start codon sites to promote protein expression at downstream start codons. This allows the boosting of endogenous protein levels for therapeutic purposes. Cas7-11-ADAR fusions could accomplish a similar effect by converting ATG sites to ITG (GTG) sites and thus remove upstream codons in endogenous transcripts and thus boost protein translation. So far, most therapeutic applications discussed have been for correcting G to A mutations or removing pre-termination sites. This would be an application that allows for boosting gene expression. A good example is boosting fetal hemoglobin levels in sickle cell disease and thalassemias.

AD-functionalized CRISPR system for RNA editing can comprise the mutagenesis of ADAR for C to U or any transition. It is possible through rational mutagenesis or directed evolution that the ADARs listed in the ortholog section could be made into C to U editors or editors of any base transition.

FIGS. 23-26 illustrates codon changes and their effects when RNA editors are used. FIG. 23A shows that modulation can be used for modifying protein function through amino acid changes that affect enzyme domains, such as kinases. FIG. 23B shows that modulation can be used for correction of Mendelian disease mutations. FIG. 23C shows the splicing modulation of transcripts by modifying the splice acceptor site. FIGS. 24A-B show potential codon transitions enabled by A>I editing. FIG. 25 shows show potential codon transitions and function enabled by C>U editing. Adapted and modified based on J. D. Watson, Molecular biology of the gene. (Pearson, Boston, ed. Seventh edition, 2014), pp. xxxiv, 872 pages (38). FIG. 66C). FIG. 26A shows that C-U modulation can be used for correction of Mendelian disease mutations. FIG. 26B shows the multiplexed creation of disease-protective alleles that requires C to U RNA editing. FIG. 26C shows the modulation of catalytic activity that requires C to U RNA editing. FIG. 26D shows alter post-translational modifications that requires C to U RNA editing.

In particular embodiments, the compositions described herein can be used in therapy. This implies that the methods can be performed in vivo, ex vivo or in vitro. In particular embodiments, the methods can be not methods of treatment of the animal or human body or a method for modifying the germ line genetic identity of a human cell. In particular embodiments, when carrying out the method, the target RNA can be not comprised within a human or animal cell. In particular embodiments, when the target is a human or animal target, the method can be carried out ex vivo or in vitro.

CRISPR-Cas Proteins and Guides

In some embodiments, the system comprises one or more components of a CRISPR-Cas system. For example, the system may comprise a Cas protein, a guide molecule, or a combination thereof.

In the methods and systems of the present invention use is made of a CRISPR-Cas protein and corresponding guide molecule. More particularly, the CRISPR-Cas protein is a class 2 CRISPR-Cas protein. In certain embodiments, said CRISPR-Cas protein is a Cas7-11. The Cas7-11 may be Cas7-11a, Cas7-11b, Cas7-11c, or Cas7-11d. The CRISPR-Cas system does not require the generation of customized proteins to target specific sequences but rather a single Cas protein can be programmed by guide molecule to recognize a specific nucleic acid target, in other words the Cas enzyme protein can be recruited to a specific nucleic acid target locus of interest using said guide molecule.

CRISPR-Cas Proteins

In some embodiments, the systems may comprise a CRISPR-Cas protein. In certain examples, the CRISPR-Cas protein may be a catalytically inactive (dead) Cas protein. The catalytically inactive (dead) Cas protein may have impaired (e.g., reduced or no) nuclease activity. In some cases, the dead Cas protein may have nickase activity. In some cases, the dead Cas protein may be dead Cas 15 protein. For example, the dead Cas 15 may be dead Cas7-11a, dead Cas7-11b, dead Cas7-11c, or dead Cas7-11d. In some embodiments, the system may comprise a nucleotide sequence encoding the dead Cas protein.

In its unmodified form, a CRISPR-Cas protein is a catalytically active protein. This implies that upon formation of a nucleic acid-targeting complex (comprising a guide RNA hybridized to a target sequence) one or both DNA strands in or near (e.g., within 1, 2, 3, 4, 5, 6, 7, 8, 9, 10, 20, 50, or more base pairs from) the target sequence is modified (e.g. cleaved). As used herein the term "sequence(s) associated with a target locus of interest" refers to sequences near the vicinity of the target sequence (e.g. within 1, 2, 3, 4, 5, 6, 7, 8, 9, 10, 20, 50, or more base pairs from the target sequence, wherein the target sequence is comprised within a target locus of interest). The unmodified catalytically active Cas7-11 protein generates a staggered cut, whereby the cut sites are typically within the target sequence. More particularly, the staggered cut is typically 13-23 nucleotides distal to the PAM. In particular embodiments, the cut on the non-target strand is 17 nucleotides downstream of the PAM (i.e. between nucleotide 17 and 18 downstream of the PAM), while the cut on the target strand (i.e. strand hybridizing with the guide sequence) occurs a further 4 nucleotides further from the sequence complementary to the PAM (this is 21 nucleotides upstream of the complement of the PAM on the 3' strand or between nucleotide 21 and 22 upstream of the complement of the PAM).

In the methods according to the present invention, the CRISPR-Cas protein is preferably mutated with respect to a corresponding wild-type enzyme such that the mutated CRISPR-Cas protein lacks the ability to cleave one or both DNA strands of a target locus containing a target sequence. In particular embodiments, one or more catalytic domains of the Cas7-11 protein are mutated to produce a mutated Cas protein which cleaves only one DNA strand of a target sequence.

In particular embodiments, the CRISPR-Cas protein may be mutated with respect to a corresponding wild-type enzyme such that the mutated CRISPR-Cas protein lacks substantially all DNA cleavage activity. In some embodiments, a CRISPR-Cas protein may be considered to substantially lack all DNA and/or RNA cleavage activity when the cleavage activity of the mutated enzyme is about no more than 25%, 10%, 5%, 1%, 0.1%, 0.01%, or less of the nucleic acid cleavage activity of the non-mutated form of the enzyme; an example can be when the nucleic acid cleavage activity of the mutated form is nil or negligible as compared with the non-mutated form.

In certain embodiments of the methods provided herein the CRISPR-Cas protein is a mutated CRISPR-Cas protein which cleaves only one DNA strand, i.e. a nickase. More particularly, in the context of the present invention, the nickase ensures cleavage within the non-target sequence, i.e. the sequence which is on the opposite DNA strand of the target sequence and which is 3' of the PAM sequence.

In some embodiments, a CRISPR-Cas protein is considered to substantially lack all DNA cleavage activity when the DNA cleavage activity of the mutated enzyme is about no more than 25%, 10%, 5%, 1%, 0.1%, 0.01%, or less of the DNA cleavage activity of the non-mutated form of the enzyme; an example can be when the DNA cleavage activity of the mutated form is nil or negligible as compared with the non-mutated form. In these embodiments, the CRISPR-Cas protein is used as a generic DNA binding protein. The mutations may be artificially introduced mutations or gain- or loss-of-function mutations.

In addition to the mutations described above, the CRISPR-Cas protein may be additionally modified. As used herein, the term "modified" with regard to a CRISPR-Cas protein generally refers to a CRISPR-Cas protein having one or more modifications or mutations (including point mutations, truncations, insertions, deletions, chimeras, fusion proteins, etc.) compared to the wild type Cas protein from which it is derived. By derived is meant that the derived enzyme is largely based, in the sense of having a high degree of sequence homology with, a wildtype enzyme, but that it has been mutated (modified) in some way as known in the art or as described herein. The modification can be fusions of effectors like fluorophore, proteins involved in translation modulation (e.g. eIF4E, eIF4A, and eIF4G) and proteins involved with epitranscriptomic modulation (e.g. pseudouridine synthase and m6a writer/readers), and splicing factors involved with changing splicing. Cas7-11 could also be used for sensing RNA for diagnostic purposes. In some embodiments, the C-terminus of the Cas7-11 effector can be truncated. For example, at least 20 amino acids, at least 40 amino acids, at least 50 amino acids, at least 60 amino acids, at least 80 amino acids, at least 100 amino acids, at least 120 amino acids, at least 140 amino acids, at least 150 amino acids, at least 160 amino acids, at least 180 amino acids, at least 200 amino acids, at least 220 amino acids, at least 240 amino acids, at least 250 amino acids, at least 260 amino acids, at least 300 amino acids, or at least 350 amino acids may be truncated at the C-terminus of the Cas 13 effector. For example, up to 120 amino acids, up to 140 amino acids, up to 160 amino acids, up to 180 amino acids, up to 200 amino acids, up to 250 amino acids, up to 300 amino acids, up to 350 amino acids, or up to 400 amino acids may be truncated at the C-terminus of the Cas 15 effector.

In some embodiments, the N-terminus of the Cas7-11 effector protein may be truncated. For example, at least 20 amino acids, at least 40 amino acids, at least 50 amino acids, at least 60 amino acids, at least 80 amino acids, at least 100 amino acids, at least 120 amino acids, at least 140 amino acids, at least 150 amino acids, at least 160 amino acids, at least 180 amino acids, at least 200 amino acids, at least 220 amino acids, at least 240 amino acids, at least 250 amino acids, at least 260 amino acids, at least 300 amino acids, or at least 350 amino acids may be truncated at the N-terminus of the Cas7-11 effector. For examples, up to 120 amino acids, up to 140 amino acids, up to 160 amino acids, up to 180 amino acids, up to 200 amino acids, up to 250 amino acids, up to 300 amino acids, up to 350 amino acids, up to 400 amino acids may be truncated at the N-terminus of the Cas7-11 effector.

In some embodiments, both the N- and the C-termini of the Cas7-11 effector protein may be truncated. For example, at least 20 amino acids may be truncated at the C-terminus of the Cas7-11 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the N-terminus of the Cas7-11 effector. For example, at least 40 amino acids may be truncated at the C-terminus of the Cas7-11 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the N-terminus of the Cas7-11 effector. For example, at least 60 amino acids may be truncated at the C-terminus of the Cas7-11 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the N-terminus of the Cas7-11 effector. For example, at least 80 amino acids may be truncated at the C-terminus of the Cas7-11 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the N-terminus of the Cas7-11 effector. For example, at least 100 amino acids may be truncated at the C-terminus of the Cas7-11 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the N-terminus of the Cas7-11 effector. For example, at least 120 amino acids may be truncated at the C-terminus of the Cas7-11 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the N-terminus of the Cas7-11 effector. For example, at least 140 amino acids may be truncated at the C-terminus of the Cas7-11 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the N-terminus of the Cas7-11 effector. For example, at least 160 amino acids may be truncated at the C-terminus of the Cas7-11 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the N-terminus of the Cas7-11 effector. For example, at least 180 amino acids may be truncated at the C-terminus of the Cas7-11 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the N-terminus of the Cas7-11 effector. For example, at least 200 amino acids may be truncated at the C-terminus of the Cas7-11 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the N-terminus of the Cas7-11 effector. For example, at least 220 amino acids may be truncated at the C-terminus of the Cas7-11 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the N-terminus of the Cas7-11 effector. For example, at least 240 amino acids may be truncated at the C-terminus of the Cas7-11 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the N-terminus of the Cas7-11 effector. For example, at least 260 amino acids may be truncated at the C-terminus of the Cas7-11 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the N-terminus of the Cas7-11 effector. For example, at least 280 amino acids may be truncated at the C-terminus of the Cas7-11 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the N-terminus of the Cas7-11 effector. For example, at least 300 amino acids may be truncated at the C-terminus of the Cas7-11 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the N-terminus of the Cas7-11 effector. For example, at least 350 amino acids may be truncated at the C-terminus of the Cas7-11 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the N-terminus of the Cas7-11 effector. For example, at least 20 amino acids may be truncated at the N-terminus of the Cas7-11 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the C-terminus of the Cas7-11 effector. For example, at least 40 amino acids may be truncated at the N-terminus of the Cas7-11 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the C-terminus of the Cas7-11 effector. For example, at least 60 amino acids may be truncated at the N-terminus of the Cas7-11 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the C-terminus of the Cas7-11 effector. For example, at least 80 amino acids may be truncated at the N-terminus of the Cas7-11 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the C-terminus of the Cas7-11 effector. For example, at least 100 amino acids may be truncated at the N-terminus of the Cas7-11 effector, and at least amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the C-terminus of the Cas7-11 effector. For example, at least 120 amino acids may be truncated at the N-terminus of the Cas7-11 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the C-terminus of the Cas7-11 effector. For example, at least 140 amino acids may be truncated at the N-terminus of the Cas7-11 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the C-terminus of the Cas7-11 effector. For example, at least 160 amino acids may be truncated at the N-terminus of the Cas7-11 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the C-terminus of the Cas7-11 effector. For example, at least 180 amino acids may be truncated at the N-terminus of the Cas7-11 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the C-terminus of the Cas7-11 effector. For example, at least 200 amino acids may be truncated at the N-terminus of the Cas7-11 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the C-terminus of the Cas7-11 effector. For example, at least 220 amino acids may be truncated at the N-terminus of the Cas7-11 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the C-terminus of the Cas7-11 effector. For example, at least 240 amino acids may be truncated at the N-terminus of the Cas7-11 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the C-terminus of the Cas7-11 effector. For example, at least 260 amino acids may be truncated at the N-terminus of the Cas7-11 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the C-terminus of the Cas7-11 effector. For example, at least 280 amino acids may be truncated at the N-terminus of the Cas7-11 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the C-terminus of the Cas7-11 effector. For example, at least 300 amino acids may be truncated at the N-terminus of the Cas7-11 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the C-terminus of the Cas7-11 effector. For example, at least 350 amino acids may be truncated at the N-terminus of the Cas7-11 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the C-terminus of the Cas7-11 effector.

The additional modifications of the CRISPR-Cas protein may or may not cause an altered functionality. By means of example, and in particular with reference to CRISPR-Cas protein, modifications which do not result in an altered functionality include for instance codon optimization for expression into a particular host, or providing the nuclease with a particular marker (e.g. for visualization). Modifications with may result in altered functionality may also include mutations, including point mutations, insertions, deletions, truncations (including split nucleases), etc. Fusion proteins may without limitation include for instance fusions with heterologous domains or functional domains (e.g. localization signals, catalytic domains, etc.). In certain embodiments, various modifications may be combined (e.g. a mutated nuclease which is catalytically inactive and which further is fused to a functional domain, such as for instance to induce DNA methylation or another nucleic acid modification, such as including without limitation a break (e.g. by a different nuclease (domain)), a mutation, a deletion, an insertion, a replacement, a ligation, a digestion, a break or a recombination). As used herein, "altered functionality" includes without limitation an altered specificity (e.g. altered target recognition, increased (e.g. "enhanced" Cas proteins) or decreased specificity, or altered PAM recognition), altered activity (e.g. increased or decreased catalytic activity, including catalytically inactive nucleases or nickases), and/or altered stability (e.g. fusions with destabilization domains). Suitable heterologous domains include without limitation a nuclease, a ligase, a repair protein, a methyltransferase, (viral) integrase, a recombinase, a transposase, an argonaute, a cytidine deaminase, a retron, a group II intron, a phosphatase, a phosphorylase, a sulpfurylase, a kinase, a polymerase, an exonuclease, etc. Examples of all these modifications are known in the art. It will be understood that a "modified" nuclease as referred to herein, and in particular a "modified" Cas or "modified" CRISPR-Cas system or complex preferably still has the capacity to interact with or bind to the polynucleic acid (e.g. in complex with the guide molecule). Such modified Cas protein can be combined with the deaminase protein or active domain thereof as described herein.

In certain embodiments, CRISPR-Cas protein may comprise one or more modifications resulting in enhanced activity and/or specificity, such as including mutating residues that stabilize the targeted or non-targeted strand (e.g. eCas9; "Rationally engineered Cas9 nucleases with improved specificity", Slaymaker et al. (2016), Science, 351(6268): 84-88, incorporated herewith in its entirety by reference). In certain embodiments, the altered or modified activity of the engineered CRISPR protein comprises increased targeting efficiency or decreased off-target binding. In certain embodiments, the altered activity of the engineered CRISPR protein comprises modified cleavage activity. In certain embodiments, the altered activity comprises increased cleavage activity as to the target polynucleotide loci. In certain embodiments, the altered activity comprises decreased cleavage activity as to the target polynucleotide loci. In certain embodiments, the altered activity comprises decreased cleavage activity as to off-target polynucleotide loci. In certain embodiments, the altered or modified activity of the modified nuclease comprises altered helicase kinetics. In certain embodiments, the modified nuclease comprises a modification that alters association of the protein with the nucleic acid molecule comprising RNA (in the case of a Cas protein), or a strand of the target polynucleotide loci, or a strand of off-target polynucleotide loci. In an aspect of the invention, the engineered CRISPR protein comprises a modification that alters formation of the CRISPR complex. In certain embodiments, the altered activity comprises increased cleavage activity as to off-target polynucleotide loci. Accordingly, in certain embodiments, there is increased specificity for target polynucleotide loci as compared to off-target polynucleotide loci. In other embodiments, there is reduced specificity for target polynucleotide loci as compared to off-target polynucleotide loci. In certain embodiments, the mutations result in decreased off-target effects (e.g. cleavage or binding properties, activity, or kinetics), such as in case for Cas proteins for instance resulting in a lower tolerance for mismatches between target and guide RNA. Other mutations may lead to increased off-target effects (e.g. cleavage or binding properties, activity, or kinetics). Other mutations may lead to increased or decreased on-target effects (e.g. cleavage or binding properties, activity, or kinetics). In certain embodiments, the mutations result in altered (e.g. increased or decreased) helicase activity, association or formation of the functional nuclease complex (e.g. CRISPR-Cas complex). In certain embodiments, as described above, the mutations result in an altered PAM recognition, i.e. a different PAM may be (in addition or in the alternative) be recognized, compared to the unmodified Cas protein. Particularly preferred mutations include positively charged residues and/or (evolutionary) conserved residues, such as conserved positively charged residues, in order to enhance specificity. In certain embodiments, such residues may be mutated to uncharged residues, such as alanine.

Type-III CRISPR-Cas Proteins

The application describes methods using Type-III CRISPR-Cas proteins. This is exemplified herein with Cas7-11, whereby a number of orthologs or homologs have been identified. It will be apparent to the skilled person that further orthologs or homologs can be identified and that any of the functionalities described herein may be engineered into other orthologs, including chimeric enzymes comprising fragments from multiple orthologs.

Computational methods of identifying novel CRISPR-Cas loci are described in EP3009511 or US2016208243 and may comprise the following steps: detecting all contigs encoding the Cas1 protein; identifying all predicted protein coding genes within 20 kB of the cas1 gene; comparing the identified genes with Cas protein-specific profiles and predicting CRISPR arrays; selecting unclassified candidate CRISPR-Cas loci containing proteins larger than 500 amino acids (>500 aa); analyzing selected candidates using methods such as PSI-BLAST and HHPred to screen for known protein domains, thereby identifying novel Class 2 CRISPR-Cas loci (see also Schmakov et al. 2015, Mol Cell. 60(3): 385-97). In addition to the above-mentioned steps, additional analysis of the candidates may be conducted by searching metagenomics databases for additional homologs. Additionally or alternatively, to expand the search to non-autonomous CRISPR-Cas systems, the same procedure can be performed with the CRISPR array used as the seed.

In one aspect the detecting all contigs encoding the Cas1 protein is performed by GenemarkS, a gene prediction program as further described in "GeneMarkS: a self-training method for prediction of gene starts in microbial genomes. Implications for finding sequence motifs in regulatory regions." John Besemer, Alexandre Lomsadze and Mark Borodovsky, Nucleic Acids Research (2001) 29, pp 2607-2618, herein incorporated by reference.

In one aspect the identifying all predicted protein coding genes is carried out by comparing the identified genes with Cas protein-specific profiles and annotating them according to NCBI Conserved Domain Database (CDD) which is a protein annotation resource that consists of a collection of well-annotated multiple sequence alignment models for ancient domains and full-length proteins. These are available as position-specific score matrices (PSSMs) for fast identification of conserved domains in protein sequences via RPS-BLAST. CDD content includes NCBI-curated domains, which use 3D-structure information to explicitly define domain boundaries and provide insights into sequence/structure/function relationships, as well as domain models imported from a number of external source databases (Pfam, SMART, COG, PRK, TIGRFAM). In a further aspect, CRISPR arrays were predicted using a PILER-CR program which is a public domain software for finding CRISPR repeats as described in "PILER-CR: fast and accurate identification of CRISPR repeats," Edgar, R. C., BMC Bioinformatics, January 20; 8:18 (2007), herein incorporated by reference.

In a further aspect, the case by case analysis is performed using PSI-BLAST (Position-Specific Iterative Basic Local Alignment Search Tool). PSI-BLAST derives a position-specific scoring matrix (PSSM) or profile from the multiple sequence alignment of sequences detected above a given score threshold using protein-protein BLAST. This PSSM is used to further search the database for new matches, and is updated for subsequent iterations with these newly detected sequences. Thus, PSI-BLAST provides a means of detecting distant relationships between proteins.

In another aspect, the case by case analysis is performed using HHpred, a method for sequence database searching and structure prediction that is as easy to use as BLAST or PSI-BLAST and that is at the same time much more sensitive in finding remote homologs. In fact, HHpred's sensitivity is competitive with the most powerful servers for structure prediction currently available. HHpred is the first server that is based on the pairwise comparison of profile hidden Markov models (HMMs). Whereas most conventional sequence search methods search sequence databases such as UniProt or the NR, HHpred searches alignment databases, like Pfam or SMART. This greatly simplifies the list of hits to a number of sequence families instead of a clutter of single sequences. All major publicly available profile and alignment databases are available through HHpred. HHpred accepts a single query sequence or a multiple alignment as input. Within only a few minutes it returns the search results in an easy-to-read format similar to that of PSI-BLAST. Search options include local or global alignment and scoring secondary structure similarity. HHpred can produce pairwise query-template sequence alignments, merged query-template multiple alignments (e.g. for transitive searches), as well as 3D structural models calculated by the MODELLER software from HHpred alignments.

Deactivated/Inactivated Cas7-11 Proteins

Where the Cas7-11 protein has nuclease activity, the Cas7-11 protein may be modified to have diminished nuclease activity e.g., nuclease inactivation of at least 70%, at least 80%, at least 90%, at least 95%, at least 97%, or 100% as compared with the wild type enzyme; or to put in another way, a Cas7-11 enzyme having advantageously about 0% of the nuclease activity of the non-mutated or wild type Cas7-11 enzyme or CRISPR-Cas protein, or no more than about 3% or about 5% or about 10% of the nuclease activity of the non-mutated or wild type Cas7-11 enzyme.

Modified Cas7-11 Enzymes

In particular embodiments, it is of interest to make use of an engineered Cas7-11 protein as defined herein, such as Cas7-11, wherein the protein complexes with a nucleic acid molecule comprising RNA to form a CRISPR complex, wherein when in the CRISPR complex, the nucleic acid molecule targets one or more target polynucleotide loci, the protein comprises at least one modification compared to unmodified Cas7-11 protein, and wherein the CRISPR complex comprising the modified protein has altered activity as compared to the complex comprising the unmodified Cas7-11 protein. It is to be understood that when referring herein to CRISPR "protein," the Cas7-11 protein is an unmodified or modified CRISPR-Cas protein (e.g. having increased or decreased or the same (or no) enzymatic activity, such as without limitation including Cas7-11. The term "CRISPR protein" may be used interchangeably with "CRISPR-Cas protein", irrespective of whether the CRISPR protein has altered, such as increased or decreased (or no) enzymatic activity, compared to the wild type CRISPR protein.

Computational analysis of the primary structure of Cas7-11 nucleases reveals 5 distinct domain regions.

Based on the above information, mutants can be generated which lead to inactivation of the enzyme or which modify the double strand nuclease to nickase activity. In alternative embodiments, this information is used to develop enzymes with reduced off-target effects.

In certain of the above-described Cas7-11 enzymes, the enzyme is modified by mutation of one or more residues (in the Cas7-like domains as well as the small subunit) including but not limited to positions listed in table 1.

Orthologs of Cas7-11

The terms "orthologue" (also referred to as "ortholog" herein) and "homologue" (also referred to as "homolog" herein) are well known in the art. By means of further guidance, a "homologue" of a protein as used herein is a protein of the same species which performs the same or a similar function as the protein it is a homologue of. Homologous proteins may but need not be structurally related, or are only partially structurally related. An "orthologue" of a protein as used herein is a protein of a different species which performs the same or a similar function as the protein it is an orthologue of Orthologous proteins may but need not be structurally related, or are only partially structurally related. Homologs and orthologs may be identified by homology modelling (see, e.g., Greer, Science vol. 228 (1985) 1055, and Blundell et al. Eur J Biochem vol 172 (1988), 513) or "structural BLAST" (Dey F, Cliff Zhang Q, Petrey D, Honig B. Toward a "structural BLAST": using structural relationships to infer function. Protein Sci. 2013 April; 22(4):359-66. doi: 10.1002/pro.2225.). See also Shmakov et al. (2015) for application in the field of CRISPR-Cas loci. Homologous proteins may but need not be structurally related, or are only partially structurally related.

The present invention encompasses the use of a Cas7-11 effector protein, derived from a Cas7-11 locus denoted as subtype III-E. Herein such effector proteins are also referred to as "Cas7-11p", e.g., a Cas7-11 protein (and such effector protein or Cas7-11 protein or protein derived from a Cas7-11 locus is also called "CRISPR-Cas protein").

In particular embodiments, the effector protein is a Cas7-11 effector protein from an organism from a genus comprising Candidatus *Jettenia caeni*, Candidatus *Scalindua brodae*, Desulfobacteraceae, Candidatus Magnetomorum, *Desulfonema ishimotonii*, Candidatus Brocadia, Deltaproteobacteria, Syntrophorhabdaceae, or Nitrospirae.

Example Cas Proteins

In certain example embodiments, the CRISPR effector protein is a Cas7-11 type III-D/III-E ortholog selected from Table 1 and FIG. 27A-27C.

TABLE 1

| SEQ ID NO & Protein ID/Contig | Sequence |
| --- | --- |
| SEQ ID NO: 1 WP_007220849 | MHTILPIHLTFLEPYRLAEWHAKADRKKNKRYLRGMSFAQWHKDKDGIGKPYITGTL<br>LRSAVLNAAEELISLNQGMWAKEPCCNGKFETEKDKPAVLRKRPTIQWKTGRPAICD<br>PEKQEKKDACPLCMLLGRFDKAGKRHRDNKYDKHDYDIHFDNLNLITDKKFSHPDDI<br>ASERILNRVDYTTGKAHDYFKVWEVDDDQWWQFTGTITMHDDCSKAKGLLLASLCF<br>VDKLCGALCRIEVTGNNSQDENKEYAHPDTGIITSLNLKYQNNSTIHQDAVPLSGSAH<br>DNDEPPVHDNDSSLDNDTITLLSMKAKEIVGAFRESGKIEKARTLADVIRAMRLQKPD<br>IWEKLPKGINDKHHLWDREVNGKKLRNILEELWRLMNKRNAWRTFCEVLGNELYRC<br>YKEKTGGIVLRFRTLGETEYYPEPEKTEPCLISDNSIPITPLGGVKEWIIGRLKAETPFY<br>FGVQSSFDSTQDDLDLVPDIVNTDEKLEANEQTSFRILMDKKGRYRIPRSLIRGVLRRD<br>LRTAFGGSGCIVELGRMIPCDCKVCAIMRKITVMDSRSENIELPDIRYRIRLNPYTATV<br>DEGALFDMEIGPEGITFPFVFRYRGEDALPRELWSVIRYWMDGMAWLGGSGSTGKG<br>RFALIDIKVFEWDLCNEEGLKAYICSRGLRGIEKEVLLENKTIAEITNLFKTEEVKFFES<br>YSKHIKQLCHECIINQISFLWGLRSYYEYLGPLWTEVKYEIKIASPLLSSDTISALLNKD<br>NIDCIAYEKRKWENGGIKFVPTIKGETIRGIVRMAVGKRSGDLGMDDHEDCSCTLCTI<br>FGNEHEAGKLRFEDLEVVEEKLPSEQNSDSNKIPFGPVQDGDGNREKECVTAVKSYK<br>KKLIDHVAIDRFHGGAEDKMKFNTLPLAGSFEKPIILKGRFWIKKDIVKDYKKKIEDA<br>MVDIRDGLYPIGGKTGIGYGWVTDLTILNPQSGFQIPVKKDISPEPGTYSTYPSHSTPSL<br>NKGHIYYPHYFLAPANTVHREQEMIGHEQFHKEQKGELLVSGKIVCTLKTVTPLIIPDT<br>ENEDAFGLQNTYSGHKNYQFFHINDEIMVPGSEIRGMISSVYEAITNSCFRVYDETKYI<br>TRRLSPEKKDESNDKNKSQDDASQKIRKGLVKKTDEGFSIIEVERYSMKTKGGTKLV<br>DKVYRLPLYDSEAVIASIQFEQYGEKNEKRNAKIRAAIKRNEVIAEVARKNLIFLRSLT<br>PEELKKVLQGEILVKFSLKSGKNPNDYLAELHENGTERGLIKFTGLNMVNIKNVNEED<br>KDFNDTWDWEKLNIFHNAHEKRNSLKQGYPRPVLKFIKDRVEYTIPKRCERIFCIPVK<br>NTIEYKVSSKVCKQYKDVLSDYEKNFGHINKIFTTKIQKRELTDGDLVYFIPNEGADK<br>TVQAIMPVPLSRITDSRTLGERLPHKNLLPCVHEVNEGLLSGILDSLDKKLLSIHPEGLC<br>PTCRLFGTTYYKGRVRFGFANLMNKPKWLTERENGCGGYVTLPLLERPRLTWSVPSD<br>KCDVPGRKFYIHHNGWQEVLRNNDITPKTENNRTVEPLAADNRFTFDVYFENLREWE<br>LGLLCYCLELEPGMGHKLGMGKPMGFGSVKIAIERLQTFTVHQDGINWKPSENEIGV<br>YVQKGREKLVEWFTPSAPHKNMEWNGVKHIKDLRSLLSIPGDKPTVKYPTLNKDAE<br>GAISDYTYERLSDTKLLPHDKRVEYLRTPWSPWNAFVKEAEYSPSEKSDEKGRETIRT<br>KPKSLPSVKSIGKVKWFDEGKGFGILIMDDGKEVSISKNSIRGNILLKKGQKVTFHIVQ<br>GLIPKAEDIEIAK |
| SEQ ID NO: 2 KHE91659 | MNITVELTFFEPYRLVEWFDWDARKKSHSAMRGQAFAQWTWKGKGRTAGKSFITGT<br>LVRSAVIKAVEELLSLNNGKWEGVPCCNGSFQTDESKGKKPSFLRKRHTLQWQANN<br>KNICDKEEACPFCILLGRFDNAGKVHERNKDYDIHFSNFDLDHKQEKNDLRLVDIASG<br>RILNRVDFDTGKAKDYFRTWEADYETYGTYTGRITLRNEHAKKLLLASLGFVDKLCG<br>ALCRIEVIKKSESPLPSDTKEQSYTKDDTVEVLSEDHNDELRKQAEVIVEAFKQNDKL<br>EKIRILADAIRTLRLHGEGVIEKDELPDGKEERDKGHHLWDIKVQGTALRTKLKELWQ<br>SNKDIGWRKFTEMLGSNLYLIYKKETGGVSTRFRILGDTEYYSKAHDSEGSDLFIPVTP<br>PEGIETKEWIIVGRLKAATPFYFGVQQPSDSIPGKEKKSEDSLVINEHTSFNILLDKENR<br>YRIPRSALRGALRRDLRTAFGSGCNVSLGGQILCNCKVCIEMRRITLKDSVSDFSEPPEI<br>RYRIAKNPGTATVEDGSLFDIEVGPEGLTFPPFVLRYRGHKFPEQLSSVIRYWEENDK<br>NGMAWLGGLDSTGKGRFALKDIKIFEWDLNQKINEYIKERGMRGKEKELLEMGESSL<br>PDGLIPYKFFEERECLFPYKENLKPQWSEVQYTIEVGSPLLTADTISALTEPGNRDAIAY<br>KKRVYNDGNNAIEPEPRFAVKSETHRGIFRTAVGRRTGDLGKEDHEDCTCDMCIIFGN<br>EHESSKIRFEDLELINGNEFEKLEKHIDHVAIDRFTGGALDKAKFDTYPLAGSPKKPLK<br>LKGRFWIKKGFSGDHKLLITTALSDIRDGLYPLGSKGGVGYGWVAGISIDDNVPDDFK<br>EMINKTEMPLPEEVEESNNGPINNDYVHPGHQSPKQDHKNKNIYYPHYFLDSGSKVY<br>REKDIIITHEEFTEELLSGKINCKLETLTPLIIPDTSDENGLKLQGNKPGHKNYKFFNING<br>ELMIPGSELRGMLRTHFEALTKSCFAIFGEDSTLSWRMNADEKDYKIDSNSIRKMESQ<br>RNPKYRIPDELQKELRNSGNGLFNRLYTSERRFWSDVSNKFENSIDYKREILRCAGRP<br>KNYKGGIIRQRKDSLMAEELKVHRLPLYDNFDIPDSAYKANDHCRKSATCSTSRGCR<br>ERFTCGIKVRDKNRVFLNAANNNRQYLNNIKKSNHDLYLQYLKGEKKIRFNSKVITG<br>SERSPIDVIAELNERGRQTGFIKLSGLNNSNKSQGNTGTTFNSGWDRFELNILLDDLET<br>RPSKSDYPRPRLLFTKDQYEYNITKRCERVFEIDKGNKTGYPVDDQIKKNYEDILDSY<br>DGIKDQEVAERFDTFTRGSKLKVGDLVYFHIDGDNKIDSLIPVRISRKCASKTLGGKLD<br>KALHPCTGLSDGLCPGCHLFGTTDYKGRVKFGFAKYENGPEWLITRGNNPERSLTLG<br>VLESPRPAFSIPDDESEIPGRKFYLHHNGWRIIRQKQLEIRETVQPERNVTTEVMDKGN<br>VFSFDVRFENLREWELGLLLQSLDPGKNIAHKLGKGKPYGFGSVKIKIDSLHTFKINSN<br>NDKIKRVPQSDIREYINKGYQKLIEWSGNNSIQKGNVLPQWHVIPHIDKLYKLLWVPF<br>LNDSKLEPDVRYPVLNEESKGYIEGSDYTYKKLGDKDNLPYKTRVKGLTTPWSPWNP<br>FQVIAEHEEQEVNVTGSRPSVTDKIERDGKMV |
| SEQ ID NO: 3 OQY58162 | MKITLRFLEPFRMLDWIRPEERISGNKAFQRGLTFARWHKSKADDKGKPFITGTLLRS<br>AVIRAAEHLLVLSKGKVGEKACCPGKFLTETDTETNKAPTMFLRKRPTLKWTDRKGC<br>DPDFPCPLCELLGPGAVGKKEGEAGINSYVNFGNLSFPGDTGYSNAREIAVRRVNRV<br>DYASGKAHDFFRIFEVDHIAFPCFHGEIAFGENVSSQARNLLQDSLRFTDRLCGALCVI<br>RYDGDIPKCGKTAPLPETESIQNAAEETARAIVRVFHGGRKDPEQAQIDKAEQIQLLSA<br>AVRELGRDKKKVSALPLNHEGKEDHYLWDKKAGGETIRTILKAAAEKEAVANQWR<br>QFCIELSEELYKEAKKAHGGLEPARRIMGDAEFSDLVPDTVSHSIGISVEKETIIMGTL<br>KAETPFFFGIESKEKKQTDLMLLLDGQNHYRIPRSALRGILRRDIRSVLGTGCNAEVGG<br>RPCLCPVCRIMKNITVMDTRSSTDTLPEVRPRIRLNPFTGSVQEKALFNMEMGTEGIEF<br>PFVLSYRGKKTLPKELRNVLNWWTEGKAFLGGAASTGKSIFQLSDIHAFSSDLSDETA<br>RESYLSNHGWRGIMENSIVHESPLEGGAGGCSFGLSDLPKLGWHAEDLKLSDIEKYKP<br>FHRQKISVKITLNSPFLNGDPVRALTEDVADIVSFKKYTQGGEKIIYAYKSESFRGVVR |

TABLE 1-continued

| SEQ ID NO & Protein ID/Contig | Sequence |
|---|---|
| | TALGLRNQGNDDITGKKNVPLIALTHQDCECMLCRFFGSEYEAGRLYFEDLTFESEPE<br>PRRFDHVAIDRFTGGAVNQKKFDDRSLVPGKEGFMTLIGCFWMRKDKELSRNEIEEL<br>GKAFADIRDGLYPLGAKGSMGYGQVAELSIVDDEDSDDENNPAKLLAESMKNASPSL<br>GTPTSLKKKDAGLSLRFDENADYYPYYFLEPEKSVHRDPVPPGHEEAFRGGLLTGRIT<br>CRLTVRTPLIVPNTETDDAFNMKEKAGKKKDAYHKSYRFFTLNRVPMIPGSEIRGMIS<br>SVFEALSNSCFRIFDEKYRLSWRMDADVKELEQFKPGRVADDGKRIEEMKEIRYPFYD<br>RTYPERNAQNGYFRWDARISLTDNSMRKMEKDGVPRNVIYKLNTLKNKAYKSEKSF<br>LFDLKNKAGGVGRYKKLVLKHAEVRGGEIPYYSHPTPTDCKLLSLVGPNRQLCRQDT<br>LVQYRIIKHRRGAKPEEDFMFVGTPSENQKGHKENNDHGGGYLKISGPNKIEKENVLT<br>SGVPSVPENMGAVVHNCPPRLVEVTVRCGRKQEEECKRKRLVPEYVCADPEKKVTY<br>TMTKRCERIFLEKSRRIIPFTNDAVDKFEILVKEYRRNAEQQDTPEAFQTILPENGTVNP<br>GDLLYFREEKGKAAEIVPVRISRKVDDRHIGKRIDPELRPCHGEWIEDGDLSKLDAYP<br>AEKKLLTRHPKGLCPACRVFGTGSYKSRVRFGFAALKGTPKWLKEDPAEPSQGKGIT<br>LPLLERPRPTWAVLHNDKENSEIPGRKFYVHHNGWKGISEGIHPISGENIEPDENNRTV<br>EVLDKGNRFVFELSFENLEPRELGLLIHSLQLEKGLAHKLGMAKSMGFGSVEIDVESV<br>RVKHRSGEWDYKDGETVDGWIEEGKRGVAAKGKANDLRKLLYLPGEKQNPHVHYP<br>TLKKEKKGDPPGYEDLKKSFREKKLNRRKMLTTLWEPWHK |
| SEQ ID NO: 4<br>KPA14974 | MLKLKVKITYFQPFRVIPWIKEDDRNSDRNYLRGGTFARWHKDKKDDIHGKPYITGT<br>LLRSALFTEIEKIKIHHSDFIHCCNAIDRTEGKHQPSFLRKRPVYTENKNIQACNKCPLC<br>LIMGRGDDRGEDLKKKKHYNGKHYQNWTVHFSNFDTQATFYWKDIVQKRILNRVD<br>QTCGKAKDFFKVCEVDHIACPTLNGIIRINDEKLSQEEISKIKQLIAVGLAQIESLAGGIC<br>RIDITNQNHDDLIKSFFETKPSKILQPNLKESGEERFELAKLELLAEYLTQSFDANQKEQ<br>QLRRLADAIRDLRKYSPDYLKDLPKGKKGGRTSIWNKKVADDFTLRDCLKNQKIPNE<br>LWRQFCEGLGREVYKISKNISNRSDAKPRLLGETEYAGLPLRKEDEKEYSPTYQNQES<br>LPKTKWIISGELQAITPFYIGHVNKTSHTRSTIFLNMMGQFCIPRSTLRGALRRDLRLVF<br>GDSCNTPVGSRVCYCQVCQIMRCIKFEDALSDVDSPPEVRHRIRLNCHTGVVEEGALF<br>DMETGFQGMIFPFRLYYESKNEIMSQHLYEVLNNWTNGQAFFGGEAGTGFGRFKLLN<br>NEVFLWEIDGEEEDYLQYLFSRGYKGIETDEIKKVADPIKWKTLFTKLEIPPEKIPLTQL<br>NYTLTIDSPLISRDPIAAMLDNRNPDAVMVKKTILVYEQDSSTHKNVPKEVPKYFIKSE<br>TIRGLLRSIISRTEIKLEDGKKERIFNLDHEDCDCLQCRLFGNVHQQGILRFEDAEITNK<br>NVSDCCIDHVAIDRFTGGGVEKMKFNDYPLSASPKNCLNLKGSIWITSALKDSEKEAL<br>SKALSELKYGYASLGGLSAIGYGRVKELTLEENDIIQLTEITESNLNSQSRLSLKPDVK<br>KELSNNHFYYPHYFIKPAPKEVVRESRLISHVQGHDTEGEFLLTGKIKCRLQTLGPLFI<br>ANNDKGDDYFELQHNNPGHLNYAFFRINDHIAIPGASIRGMISSVFETLTHSCFRVMD<br>DKKYLTRRVIPESETTQKRKSGRYQVEESDPDLFPGRVQKKGNKYKIEKMDEIVRLPI<br>YDNFSLVERIREYHYSEECASYVPSVKKAIDYNRMLAQAADSNREFLYNHPEAKSILQ<br>GKKEVYYILHKQESKNRGKTKEINPNARYACLTDENTPGSRKGFIKFTGPDMVTVNK<br>ELKSKIAPIYDPEWEKDIPDWERSNQESNHKYSFILHNEIEMRSSQKKKYPRPVFICKK<br>NGVEYRMQKRCERIFDFTKEEEKDKEIVIPQKVVSQYNAILKDNKENTETIPGLENSK<br>MVNKELEDGDLVYFKYKEGKVTELTPVAISRKTDNKPMGKRFPKISINGKMKPNDSL<br>RSCSHTCTEDCDDCPNLCESVKDYFKPHPDGLCPACHLFGTTFYKSRLSFGLAWLEN<br>NAKWYISNDFQQKDSKKEKGGKLTLPLLERPRPTWSMPNNNAEVPGRKFYVHHPWS<br>VENIKNNQGNQKDISLKPDSDAIKIKENNRTIEPLGKDNVFNFEISFNNLRDWELGLLL<br>YAIELEDHLAHKLGMAKAFGMGSVKIEIKNLLIKGSINDISKAELIKKGFKKLGIDSLE<br>KDDLSEYLHIKQLREILWFSDKPVGTIEYPKLENKTNSRIPSYTDFVQEKDHETGFKNP<br>KYQNLKSRLHILQNPWNAWWKNEE |
| SEQ ID NO: 5<br>WP_124327589 | MTTTMKISIEFLEPFRMTKWQESTRRNKNNKEFVRGQAFARWHRNKKDNTKGRPYIT<br>GTLLRSAVIRSAENLLTLSDGKISEKTCCPGKFDTEDKDRLLQLRQRSTLRWTDKNPC<br>PDNAETYCPFCELLGRSGNDGKKAEKKDWRFRIHFGNLSLPGKPDFDGPKAIGSQRV<br>LNRVDFKSGKAHDFFKAYEVDHTRFPRFEGEITIDNKVSAEARKLLCDSLKFTDRLCG<br>ALCVIRFDEYTPAADSGKQTENVQAEPNANLAEKTAEQIISILDDNKKTEYTRLLADAI<br>RSLRRSSKLVAGLPKDHDGKDDHYLWDIGKKKKDENSVTIRQILTTSADTKELKNAG<br>KWREFCEKLGEALYLKSKDMSGGLKITRRILGDAEFHGKPDRLEKSRSVSIGSVLKET<br>VVCGELVAKTPFFFGAIDEDAKQTDLQVLLTPDNKYRLPRSAVRGILRRDLQTYFDSP<br>CNAELGGRPCMCKTCRIMRGITVMDARSEYNAPPEIRHRTRINPFTGTVAEGALFNME<br>VAPEGIVFPFQLRYRGSEDGLPDALKTVLKWWAEGQAFMSGAASTGKGRFRMENAK<br>YETLDLSDENQRNDYLKNWGWRDEKGLEELKKRLNSGLPEPGNYRDPKWHEINVSI<br>EMASPPINGDPIRAAVDKRGTDVVTFVKYKAEGEEEAKPVCAYKAESFRGVIRSAVARI<br>HMEDGVPLTELTHSDCECLLCQIFGSEYEAGKIRFEDLVFESDPEPVTFDHVAIDRFTG<br>GAADKKKFDDSPLPGSPARPLMLKGSFWIRRDVLEDEEYCKALGKALADVNNGLYP<br>LGGKSAIGYGQVKSLGIKGDDKRISRLMNPAFDETDVAVPEKPKTDAEVRIEAEKVY<br>YPHYFVEPHKKVEREEKPCGHQKFHEGRLTGKIRCKLITKTPLIVPDTSNDDFFRPADK<br>EARKEKDEYHKSYAFFRLHKQIMIPGSELRGMVSSVYETVTNSCFRIFDETKRLSWRM<br>DADHQNVLQDFLPGRVTADGKHIQKFSETARVPFYDKTQKHFDILDEQEIAGEKPVR<br>MWVKRFIKRLSLVDPAKHPQKKQDNKWKRRKEGIATFIEQKNGSYYFNVVTNNGCT<br>SFHLWHKPDNFDQEKLEGIQNGEKLDCWVRDSRYQKAFQEIPENDPDGWECKEGYL<br>HVVGPSKVEFSDKKGDVINNFQGTLPSVPNDWKTIRTNDFKNRKRKNEPVFCCEDDK<br>GNYYTMAKYCETFFFDLKENEEYEIPEKARIKYKELLRVYNNNPQAVPESVFQSRVA<br>RENVEKLKSGDLVYFKHNEKYVEDIVPVRISRTVDDRMIGKRMSADLRPCHGDWVE<br>DGDLSALNAYPEKRLLLRHPKGLCPACRLFGTGSYKGRVRFGFASLENDPEWLIPGK<br>NPGDPFHGGPVMLSLLERPRPTWSIPGSDNKFKVPGRKFYVHHHAWKTIKDGNHPTT<br>GKAIEQSPNNRTVEALAGGNSFSFEIAFENLKEWELGLLIHSLQLEKGLAHKLGMAKS<br>MGFGSVEIDVESVRLKDWKQWRNGNSEIPNWLGKGFAKLKEWFRDELDFIENLKK<br>LLWFPEGDQAPRVCYPMLRKKDDPNGNSGYEELKDGEFKKEDRQKKLTTPWTPWA |

TABLE 1-continued

| SEQ ID NO & Protein ID/Contig | Sequence |
|---|---|
| SEQ ID NO: 6 KKO18793 | MSKTDDKIDIKLTFLEPYRMVNWLENGLRMTDPRYLRGLSFARWHRNKNGKAGRPY ITGTLLRSAVIRAAEELLSLNLGKWGKQLCCPGQFETEREMRKNKTFLRRRPTPAWSA ETKKEICTTHGSACAFCLLLGRRLHGGKEDVNEDAPGSCRKPVGFGNLSLPFQPTKRQ IQDVCKERVLNRVDFRTGKAQDYFRVFEIDHEDWGVYTGEITITEPRVQEMLEASLKF VDTLCGALCRIEIVGSADETKRTTSSKEGCPASTTTRDCSSSENDDTSPEDPVREDLKK IAHVIANAFQNSGNREKVHALADAIRAMRLEESSIINTLPKGKSEKTTEQIEVNKHYL WDEIPVNDTSVRHILIEQWRRWQSKKDDPEWWKFCDFLGECLYKEYKKLTSGIQSRA RVMGETEYYGALGMPDKVIPLLKSDKTKEWILVGSLKAETPFFFGLETEQTEEVEHTS LRLVMDKKGRFRIPRSVLRGALRRDMRIAFDSGCDVKLGSPLPCDCSVCQVMRSITIK DSRSEAGKLPQIRHRIRLNPFSGTVDEGALFDIEVAPEGVIFPFVMRYRGEEFPPALLSV IRYWQDGKAWLGGEGATGKGRFALAKDLKMYEWKLEDKSLHAYIDTYGHRGNEH AIGTGQGIDGFRSGSLSDLLSDISKESFRDPLASYHNYLDKRWIKVGYQITIGAPLLSAD PIGALLDPNNVDAIVFEKMKLDGDQVKYLPAIKGETIRGIVRTALGKRNNLLAKNDH DDCTCSLCAIFGNENETGKIRFEDLEVYDKDIAKKIDHVAIDRFTGGARDQMKFDTLP LIGSPERPLRLKGLFWMRRDVSPDEKARILLAFLEIREGLYPIGGKTGSGYGWVSDLEF DGDAPEAFKEMNSKRGKQASFKEKISFRYPSGAPKHIQNLKATSFYYPHYFLEPGSKV IREQKMIGHEQYYESYPSGASGEKLLSGRIICSMTTHTPLIVPDTGVIKDPENKHATYD FFQMNNAIMIPGSEIRGMISAVYEAMTNSCFRIFHEKQYLTRRISPEDKELREFIPGIVRI INGDVYIEKAEREYRLPLYDDVHIITNYEELEYEKYIKKNPGREQKIKNAHRFNKNIAR IAESNRNYLCSLDRAVRREILSGRKKVNFRLVKVNDNKNPDKEAVELCKTGPLEGLV KFSGLNAVNISNLRPGTAEEGFDAKWDMWSLNIILNRMDVRNSQKKEYPRPALHFNH DGKEYTIPKRCERVFVRAEAGKRAETEGSYKVPRKVQEQYQNILRDYESNIGHIDNTF RTLIENCGLNNGSLVYFKPDNSRKEVVAITPVKISRKTDRLPQGDRFPHTSSDLRPCVR DCLDTEGDIRMLENSPFKRLFHIHPEGLCPACQLFGTTNYRGRVRFGFASLSDGPKWF RKDEGNETCHITLPLLERPRPTWSMPDDTSTIPGRKFYVHHMGYETVKKNQRTLVKT ENNRTVKALDKENEFTFEVFFENLREWELGLLLHCLELEPEMGHKLGMGKPLGFGSV KIRIDKLQKCVVNVKDGCVLWEPEEDKIQHYIAKGLGKLTTWFGKEWDRLEHIQGLR SLQRLLPL |
| SEQ ID NO: 7 RLC14096B | FESYARWCKSNSGLWKPYIPGTLLRSAVLESVEYLLALIGSKNKVEICPGLYTQSENN PDTKYLRRRPWYELHAQKEICKTRDTACPLCLLMRTKLDNDGDGETEKNVKFGNLY PTSPLEPLQKIRPRILNRMDPGTSKARDYFRVFEIENQLCSQFRGWIWLSGDLPNMELV KSLLAAGLSNVATLAGAVCRIRIVSTDNPSMKQDLTTQDLIDDFTNYYLKGDTPPANL AASGKGDAFPRFSPGSGDHPDTTGVSHADMASSHEGTALAKDIAEKCKDILSQISASE QLRRLADIMRDLRQDSNREIMYRQVAEENHEKASLLYKKTKKGDSIAALIAGKTEGM DAETWRRLCEFLGQTFYGEAKEAGLVETPVPRILGESERYSLQKKPTVRTDLAAELVP DIEFIIKGNLIAETPFFFGTDIATETHTDLPILLTSDRHFRIPRSVLRGILRRDLRLVTGSG CSVKLGRSEPCACDVCQIMRSLTMRDCVSSCKVPPEIRHRIRLNPVTETVEEGALFDM EIGPQGISFPPFVLRSRGVNSSFSTRLKNVLTWWSEGKIFMGGDKGTGKGRFTLAELEA YYFRITTKRIGKNVWVIGNYLKSQGWRGAELETHFDSLKEWKSLSFSDSDVKVFTW HKITWKVSFEGPVLTNDPIAADIRNESDAVFYQKSVAGEKGPVYALKGEGLRGIVSSS LCKKKNLSSNLHEDCECLRCKIFGSKHQEGNIRFEDMTVSQESEVREKLFDHVSIDRFT GGAANKLKFDDKPLVGNPLVFQGVFWVHQSIGNNEKTQEALSDAFKDVRDGLYPVG AKGSIGYGWIKGIEVVEGPDWLKDALSAEKTVEAGIASEESEYKLPDLPWISLLPKGR AIYNPHYFLGIPKVTPEREREPVGHDRFQTDLHTGRIICTLKTITPLIIPDTENDKAFEVE NASADHERFKFMRMGSQAAIPGSAIRSMTSSVFEALTNSCFRVLDQKSHLSWRMEAD DAGDYKPGRFEKKDDKAVIRKFKKKARFPPYAGPDTREAFTSDQIMGKEKVTLWVK DFEASLTVPDEIGWKKKRGYLKVTGPNKVEIDTENISENNPSPPDSWQDVRINDDGTIP DKKNRKFICQYGTTTYTVDKWCEAFFCDEEKDPYELAPDVERKYRLLMDSYHNNPQ APPQIFRSLPLFSETGPKKTLEHGDLVYFRLSEVNKQSQSKKQVRERVTDIVPVSISRIA NNQPIGKHIAAAFRPCAYVCIEECEPCDAKTCPIPVYREGYPIKGLCRACHLFGTTYK GRVRFSFAKLNGDAVWAKGAGGKDYFTLPLLEKPRPTWTMPNEGAKIPGRKFYVHH NEWKTVQEGKNPIDQKAIRPNPNNSSVEVLNLGNEFQFEVSFENLEEWELGLLLYCLE LEPGLAHKLGRGKAFGFGSIEAEVSKIEMRIKSGTWKNETSGKEKFIQSGLSQVPSFFK QDEKQWNKVEQVKNIRKLLQLSWNKGNAVEPEVRYPALREKDDENKRPGYVELKD NGYDAGKKLVSPWAPWHPIKK |
| SEQ ID NO: 8 OGR07205 | MTKKPGTEDKATLWGKESASKSVKTILEESIQGFTVEQKRSFFANLADQLVSRAGEQ GAKSVRSQGLIIGRKENYAKPSAQEPTRHHLYRQPSNASAFLATGWLIAETPFFIGSGT EGQKQTDDQAESLHLRTLRDGHGRFRIPFTTIRGVMDKELRDILQAGCAKGRSLRAPC PCQVCTLMRRIQVRDAIAADILPPDLRMRTRIDPSHGTVAHLFSLEMAPQGLKLPFFLK LKGVETIDPDKELLEILNDWSAGQCFLGGLWGTGKGRFRLDDLQWHRLELDNADYY TPLLQDRFFAGETISDLRQGLQSINIQPERIPAQTPSRNMPYCRVDCILEFKSPVLSGDP VAALFESDAPDNVAYKKPVVQYDETGRLRTTDPGPVEMLTCLKGEGVRGVVAYLAG KAYDQHDLSHDSCNCTFCQAFGNGQKAGSLRFDDFMPVQFESDQAGNFSWSPHTPH AMRSDRVALDVFGAMPEAKFDDRPLAASPGKPLNFKSTIWYREDMGKEAGKALKR ALIDLQNNMAAIGSGGGIGRGWVSRVCFEGDIPDFLEDFPEPITVTEPEQDSQLLKNQA VADETAVSACDTDAPHPLAVTLEPGARYFPRVIIPRAPTVKRDECVTGQRYHTGRLS GKIFCELNTLGPLFVPDTDYSAGVPVPISDEQLAECQLQAVFENTSKFNEFFATYPEET VTKLKDLLCAADDKWILAVKDITADLRQEIGEDTFQRIIRKAGHKTQRFHQINDEIGLP GASLRGMVLSNYQILTNSCYRNLKATEEITRRMPADEAKYRKAGRVTVSGDGAQKK YSIQEMEVLRLPIYDNMNTPDNMPDVAKQATTAKRCNNLMNEAAKTSRVELKARW REGQSKIKYQIIDALNKVDPIIQVISSSKQINPNNGKTGWGYVKYTGANVFAKSLVAPI DCLRKKDAGHVCCQVNLNPAWEASNFDILINEKCPVERQSGPRPTLRCKGQDSAWY TLTKRSERIFTDKKPVPDPINIPPREVKRYNELRDSYKKNTAHVPKPLQTFFNQESLAN |

TABLE 1-continued

| SEQ ID NO & Protein ID/Contig | Sequence |
| --- | --- |
| | GDLVYFEVNQFGEASQLTPVSISRTTDLFPIGGRLPQGHKDLFPCTAMCLSECKNCVP<br>ASFCEFHSRSHEKLCPACSLAGTTGNRGRIKFSEAWLSGLPKWHSVSQDNVGRGLGV<br>TMPRLERSRRTWHLPTKDAYLLGQSIYLNHPVPAILPSDQVPSENNQTVEPLGPKNIFS<br>FQLAFDNLSIEELGLLLYSLELESGMAHRLGRGRALGMGSVQISVKDIQIRDNKSFLFS<br>SNISKKSEWIQCGKDEFAQEAWFGESWDNIDHIQRLRQALTIPVKGDVGCIRYPKLEA<br>EGGMPDYIKLRKRLTPLCDREEPVRYRINPVQLARMILPFVPWHGACPALLNEQVMIE<br>AKRLTELXXXDRANWPC |
| SEQ ID NO: 9<br>RLC14096 | ASEDDDTPTLRKVLKDEINGQEDMWRKFCEALGNSLYDLSKKAKERKRTEALPRLLG<br>ETEIYGLPMRENKEDEPLPSSLTYKFKWLIAGELRAETPFFFGTEVQEGQTSATILLNR<br>DGYFRLPRSVIRGALRRDLRLVMGNDGCNMPIGGQMCECGVCRVMRHIVIEDGLSDC<br>KIPPEVRHRIRLNCHTGTVEEGALFDMETGYQGMTFPFRLYCETENSDLDSYLWEVL<br>NNWQNGQSLFGGDTGTGFGRFELTEPKVFLWNFSKKEKHEAYLLNRGFKGQMPVQD<br>VKTKSFKTKTWFQIHRELDISPKKLPWYSTDYRFNVTSPLISRDPIGAMLDPRNTDAIM<br>VRKTVFCPDPNAKNRPAPATVYMIKGESIRGILRSIVVRNEELYDTDHEDCDCILCRLF<br>GSIHQQGSLRFEDAEVQNSVSDKKMDHVAIDRFTGGGVDQMKFDDYPLPGCPAQPLI<br>LEGKFWVKDDIDDESKSALEKAFADFRDGLVSLGGLGAIGYGQIGDFELIGGSADWL<br>NLPKPEENRTDVPCGDRSAQGPEIKISLDADKIYHPHFFLKPSDKNVYRERELVSHAK<br>KKGPDGKSLFTGKITCRLSTEGPVFIPDTDLGEDYFEMQASHKKHKNYGFFRINGNVA<br>IPGSSIRGMISSVFEALTNSCFRVFDQERYLSREKPDPTELTKYYPGKVKRDGNKFFIL<br>KMKDFFRLPLYDFDFEGEAESLRPNYDEDRNEEENKGKNKNTQKVKNAVEEFNIKMA<br>GFAKHNRDFLKKYKEQEIKDIFMGKKKVYFTAGKHKPNEAHDNDKIALLTKGSNKK<br>AEKGYFKFTGPGMVNVKAGVEGEECDFHIDESDPDVYWNMSSILPHNQIKWRPSQK<br>KEYPRPVLKCVKDGTEYVMLKRSEHVFAEASSEDSYPVPGKVRKQFNSISRDNVQNT<br>DHLSSMFQSRRLHDELSHGDLVYFRHDEKRKVTDIAYVRVSRTVDDRPMGKRFKNE<br>SLRPCNHVCVEGCDECPDRCKELEDYFSPHPEGLCPACHLFGTTDYKGRVSFGLGWH<br>ESNTPKWYMPEDNSQKGSHLTLPLLERPRPTWSMPNKKSEIPGRKFYVHHPWSVDKI<br>RNRQFDPAKEKQPDDVIKPNENNRTVEPLGKGNEFTFEVRFNNLREWELGLLLYSLEL<br>EDNMAHKLGMGKALGMGSARIKAEAIELRCESAGQNAELKDKAAFVRKGFEFLEID<br>KPGENDPMNFDHIRQLRELLWFLPENVSANVRYPMLEKEDDGTPGYTDFIKQEEPST<br>GKRNPSYLSSEKRRNILQTPWKHWYLIPPFQASAQSETVFEGTVKWFDDKKGFGFIKI<br>NDGGKDVFVHHSSIVGTGFKSLNEGDSVAFKMGVGPKGPCAEKVKKIGN |
| SEQ ID NO: 10<br>OPY65763 | MRRQRLLGDAEYYGGTGREQPASIVISTDSDPDHKVYEWIITGQLKAETGFFFGTKAG<br>AGGHTDLSILLGKDGHYRVPRSVFRGALRRDLRVAFGAGCRVEVGRERPCECPVCKV<br>MRQITVMDTISSYREAPEIRQRIRLNPYTGTVDKGALFDMEVGPEGIEFPFVLRFRGSK<br>SFPSELAAVIGSWTKGTAWLGGAAATGKGRFSLLGLSIHKWNLSTAEGRKSYLAAYG<br>LRDAADKTVKRLSIDKGGKGDVGLPAGLERDALPSSVREPLWKKLVCTVDFSSPLLL<br>ADPIAALLGVEGDERIGFDNIAYEKRRYNGETNTTESIPAVKGETFRGIVRTALGKRHG<br>NLTRDHEDCRCRLCAVFGKEQEAGKIRFEDLMPVGAWTRKHLDHVAIDRFHGGAEE<br>NMKFDTYALAASPTNPLRMKGLIWVRSDLFETGHDGPTPPYVKDIIDALADVKRGLY<br>PVGGKTGSGYGWIKDVTIDGLPQGLSLPAEERVDGVNEVPPYNYSAPPDLPSAAEGE<br>YFFPHVFIKPYDKVDRVSRLTGHDRFRQGRITGRITCTLKTLTPLIIPDSEGIQTDATGH<br>KMCKFFSVAGKPMIPGSEIRGMISSVYEALTNSCFRVFDEEKYLTRRVQPKKGAKSSE<br>LVPGIIVWGQNGGLAVQQVKNAYRVPLYDDPAVTSAIPTEAQKNKERWESVPSVNL<br>QGALDWNLTTANIARDNRTFLNSRPEEKDAILSGTKPISFELEGTNPNDMLVRLVPDG<br>VDGAHSGYLKFTGLNMVLKANKKTSRKLAPSEEDVRTLAILHNDFDSRRDWRRPPNS<br>QRYFPRSVLRFSLERSTYTIPKRCERVFEGTCGEPYSVPSDVERQYNSIIDDISKNYGRIS<br>ETYLTKTANRKLTVGDLVYFIADLDKNMATHILPVFISRISDEKPLGELLPFSGKLIPCE<br>GEPPTILKKMAPSLLTEAWRTLISTHLEGFCPACRLFGTTSYLGKGRIRFGFAEHTGTPKW<br>LREELDWARPFLTLPIQERPRPTWSVPDDKSEVPGRKFYLHHGGNRIVESNLRNRPE<br>VNQTKNNSSVEPISAGNTFTFDVCFENLEAWELGLLLYCLELSPKLAHKLGRAKAFGF<br>GSVKIHVERIEERTTDGAYQDVTAVKKNGWITTGHDKLREWFHRDDWEDVDHIRNL<br>RTVLRFPDADQEHDVRYPELKANNGVSGYVELRDKMTASERQESLRTPWYRWFPQN<br>GTGGSGRHEQAATSQEQDTAKDESVLSATQRRQAVIDVSDPDERLSGTVESFDRQKG<br>DGYIGCGVRQFYVRLEDIRSRTALCEGQVVTFRARKEWEGHEAYDVEIDQ |
| SEQ ID NO: 11<br>RLC02083 | MLEKALADFRDGVVSLGGLGAIGYGRIGDFEVAEESGTWLKIPEKKLPEDSVQCGER<br>YRFSSDPATRFEKEKIYYPHYFLKPSDEDVRRETRLVSHVYQEDTDGKTRLLTGTIRC<br>RLTTEGPIFIPDTDDPKEDYFQMEIEGHKSYGFFRINEQVAIPGSSIRGMVSSVFEALTN<br>SCFRVFDQKRYLSRSTKPDPRELEKYLPGKVKRIDNKWVLLELEDIFRLPYDLKDVG<br>PKSLDSAYGLEKFKNEKRFRLKKIENAVAFNKKMAGYAKHTREFLKNNYTETELGKI<br>LRGEMKVWFTIGHKPNSAHDNDKIALLTKKTNKRAKSGFIKFTGPSMVNIKADASNS<br>DCEECRFDMKSEDKDGLIFHNAIECRPSQKKEYPRPVLKCVKEAVEYTMIKRCEQVFS<br>EGKKPPRSYSIPDKSRRQYNGILKDNRDNTEHIPSFFRNRMKNKELSDEDLVYFRYKG<br>KKVTNIAPVRVSR |
| SEQ ID NO: 12<br>RLC02082 | QYNLPLNPDAFPKFRWIVTGHLRAETPFFFGRGEIKDRTIEEETEQTSKTILLNKDNFFR<br>LPRSVIRGALRRDLRLVIGNGCNTPVGGKFCECDVCRIMRHVVVEDTISSCRKPPEIRY<br>NIRLNGHTRTVEEGALFDTETGYQGMRFPFRLCFETRASEFDPDTSEPIPKFDPYLSEV<br>MKHWKAGQAVFGGDTGAGFGRFRLEGDIRFFSMDVAKKEEYDPYLLARGFKGMSS<br>QEILEKIGSGRTYDWNSVPKIALNIPPNKLPWKEICYTIEVISPLISRDPIRAMMDPRNT<br>DTIMIRKVFVPDGKGGTLPEPESRYFIKSETLRGILRSLVGGNKTADGEYLCDLDHED<br>CDCVQCRLFGSIHQQGCLRFEDAEVWNSVRDKKMDHVAIDRFTGGALDQMKFDDYP<br>LLGCPEYPVILGGRFWIRDDISDKEKEIA |

TABLE 1-continued

| SEQ ID NO & Protein ID/Contig | Sequence |
|---|---|
| SEQ ID NO: 13 OPY65764 | MESIPVTLTFLEPYRVVEWYANEDRRSAERYLRGQSFARWHRKKNDKKGRPYITGTL LRSAAIRAAEELLSLSGGVWDGQHCCKGQFLSGGVKPEYMRKRPTYIWAEKEGACS APDYCPFCIFLGDRDQAEKKAESQNGYPDKSYHIRFGNLSLPDPPPLLDLKEVAVERT LNRVDFQTAKAHDYFKVWEISHEDLGVYTGQIVIHYTGPWQEKVKSLLEGSLRFVDR LCGALCKIEMAPKPARPLPKSLSVDMTEHAKIIVTAFDDAKKAEKVRGLADAMRSMG SKGPTILDKLPAGHDDRDHHTWDVTIVDKTPLRTYLKGVLRADDAASWPALCKALG NALYDVSQG |
| SEQ ID NO: 14 RME63343 | EKQGFRDKGFNIVGSLKDAIGKEIGLREISLRPAKEETMPRWQCVEYTIIVNSPLHTAD PIEALLHSGNYDSVVYKKTVVRNGNIKQIPVFKGETIRGIVRTAFARILRTENVEFDEE HEDCTCPLCQVFGNEHRAGRVRFEDLVIEGYTSEKKFDHVSIDRFTGGAAEKRKFDD LSLKGSPRRPIVLRGKVWIRNDMSKGIEKLKQAFMDIRDGLYPLGSRGGIGYGWVT DLKIENTEVEEFRLDKVSTTEGSGPATEEFNFPSLPEIQLNKDAVYHPHYFIRPHEKVN REIRPVGHERFHDDLLTGRIKCTLKTLTPLIIPDTEDPDAFGLQAEHKGHQNFRFFR |
| SEQ ID NO: 15 Ga0190306_ 10003932 | MKSIPITLTFLEPYRILPWAEKGKRDKKEYLRGANYVRLHKDKNGKFKPYITGTLIRS AVLSAIEMLLDITNGEWNGKECCLAKFHTEGEKPSFLRKKPIYIRAEKDEICTSRETAC PLCLILGRFDKAEKKEKDKEKFDVHFSNLNLYSSKEFSTIEELAPKRALNRIEQYTGKA QDYFTVYEALNKEFWTFKGRIRIKEDIYDKVTDLLFSALRCVEKIAGALCRIEIDKEPS QQKGFVKRQLSKQAKEDIEKIFQVVKDAQKLRLLSDCFRELTRMANKDELALPLGPE DDGHYLWDKIKVEGKTLRIFLRNCFSQYKDNWLCFCDEASKKGYQKYREKRHKLTD RELPTATPKHFAEKKDPQISPIYIDKDDKVYEWIIVGRLIAQTPFHFGDEEKAEGAILLT PDNRFRLPRTALRGILRRDLKLAGASACEVEVGRSEPCPCDVCKIMRRVTLLDTVSED LRDFLPELRKRIRINPQSGTVAEGALFDTEVGPEGLSFPFVLRYKCEKLPDSLTTVLCW WQEGLAFLSGESATGKGRFRLEINGAFVWDLQKGLFNYIKNHGFRGEERLFLEGNEA ELEKMGIQINTELLQPEMIKKEKNFTDFPYDLIKYQLNISSPLLLNDPIRAIALYEGEGK APDAVFFKKYVFENGKIEEKPCFKAESIRGIFRTAVGRIKNVLTKNHEDCICVLCHLFG NVHETGRLKFEDLKIVSGQEEKFFDHVAIDRFLGGAKEKYKFDDKPIIGAPDTPIVLEG KIWVKKDINDEAKETLSQAFSDINTGIYYLGANGSIGYGWIEEVKALKAPSWLKIKEK PNFEKDTSLNISAIMNEFKKDIQTLNLDKTYLPYGFLKLLEKVKRTSSPITHERFYENH LTGFIECSLKVLSPLIIPDTETPEKEENGHKYYHFLKIDNKPIIPGAEIRGAVSSIYEALTN SCFRVFGEKKVLSWRMEGKDAKEFMPGRVSKKKGKLYMVKMQALRLPVYDNPALA NEIRSGSIYEKYKNSKVEIIFFQTVEGIRKFLRGNFNNVEWKKVLVTGIDPLAILPSQKIP GNDKWVKNLQSKISPVRGYFKFTGPNKIETKRREEEKDEKLRTKANKVSCLQKDKW YEAMHNHVEYKQDYTPPNSPKTEPLERPRNIPCFVCSDKEKIYRMTKRCERVFVSLGE NAPKYEIPISAIKRYEVILSAYRENWERNKTPELFRTRLPGDGRTLNEDDLVYFRADEN EKVKDIIPVCISRIVDEVPLIKRLSQELWPCVLAECPLLGFECKKCELEGLPEKIWFRIN KDGLCPACRLFGTQIYKSRVRFSFAYAKNWKFYDGYITLPRLESPRATWLILKEKDKH YIKYKVCGRKFYLHNSTYEDIINNSKKEKEKKTENNASFEVLKEGEFTFKVYFENLEN WELGLLLLSLTGLGEAIKIGHAKPLGFGSVKIEAKKIYFREEAGKFHPCEKADEYLKK GLNKLTSWFGKNEINEHMRNLLLFMTYYQNLPKVKYPDFDGYAKWRCSYVEQDKV EYFQNRWIVAS |
| SEQ ID NO: 16 Ga0193932_ 104825 | MIINITVKFLGPFRMLEWTDPDNRNRKNREFMRGQAFARWHNSNPQKGSQPYITGTL VRSAVIRSAENLLMLSEGKVGKEKCCPGEFRTENRKKRDAMLHLRQRSTLQWKTDK PLCNGKSLCPICELLGRRIGKTDEVKKKGDFRIHFGNLTPLNRYDDPSDIGTQRTLNRV DYATGKAHDFFKVWEIDHSLLSVFQGKISIADNIGDGATKLLEDSLRFTDRLCGAICVI SYDCIENSDGKENGKTGEAAHIMGESDAGKTDAENIANAIADMMGTAGEPEKLRILA DAVRALRIGKNTVSQLPLDHEGKENHHLWDIGEGKSIRELLLEKAESLPSDQWRKFCE DVGEILYLKSKDPTGGLTVSQRILGDEAFWSKADRQLNPSAVSIPVTTETLICGKLISET PFFFGTEIEDAKHTNLKVLLDRQNRYRLPRSAIRGVLRRDLRTAFGGKGCNVELGGRP CLCDVCRIMRGITIMDARSEYAEPPEIRHRIRLNPYTGTVAEGALFDMELGPQGLSFDF ILRYRGKGKSIPKALRNVLKWWTKGQAFLSGAASTGKGIFRLDDLKYISFDLSDKDK RKDYLDNYGWRNRIEALSLEKMPLDRMNDYAEPLWQKVSVEIEIGSPFLNGDPIRALI EKDGSDIVSFRKYADDSGKEVYAYKAESFRGVVRAALARQHFDKEGKPLDKEGKPL LTLIHQDCECLICRLFGSEHETGRLRFEDLLFDPQPEPMIFDHVAIDRFTGGAVDKKKF DDCSLPGTPGHPLTLKGCFWIRKELEKPDEDKSEREALSKALADIHNGLYPLGGKGAI GYGQVMNLKIKGAGDVIKAALQSESSRMSASEPEHKKPDSGLKLSFDDKKAVYYPH YFLKPAAEEVNRKPIPTGHETLNSGLLTGKIRCRLTTRTPLIVPDTSNDDFFQTGVEGH ESYAFFSVNGDIMLPGSEIRGMLSSVYEALTNSCFRVFDEGYRLSWRMEADRNVLMQ FKPGRVTDNGLRIEEMKEYRYPFYDRDCSDKKSQEAYFDEWERSITLTDDSLEKMAE RKGDISPKDLKVLKSLKGKNYKSTEGLLAAFKDKGGDTGGNILGLIFKYAERIGDVPR YEHPTDTDRMMLSLSEYNRNQKSDGKRAYKIIKPASKLGKGAYFMFAGTSVENKRIC NPACTDKANKSVKGYLKISGPNKLEKYNISEPELDGVPEDRNCQIIHNRIYLRKIFVAN AKKRKERDRLVGEFACYDPEKKVTYSMTKRCERIFIKDRGRTLPITHEASELFEILVQE YRENAKRQDTPEVFQTLLPDNGRLNPGDLVYFREEKGKTVEIIPVRISRKIDDSPIGKR LREDLRPCHGEWIEGDDLSQLSEYPEKKLFTRNTEGLCPACRLFGTGAYKGRLRFGFA KLENDPKWLMKNSDGPSHGGPLTLPLLERPRPTWSMPDDTLNRLKKDGKQEPKKQK GKKGPQVPGRKFYVHHDGWKEINCGCHPTTKENIVQNQNNRTVEPLDKGNTFSFEIC FENLEPYELGLLLYTLELEKGLAHKLGMAKPMGFGSIDIEVENVSLRTDSGQWKDAN EQISEWTDKGKKDAGKWFKTDWEAAEHIKNLKKLLFLPGEEQNPRVIYPALKQKDIP NSRLPGYEELKKNLNMEKRKEMLTTPWAPWHPIKK |
| SEQ ID NO: 17 Ga0190283_ 10011062 | MTQITIQVTFFHPFRVVPWNHRDHRKTDRKYLRGGTFAKWHCTASEGKSGRPYITGT LLRSALFAEIEKLIAFHDPPFKCCRGKDKTENGNAKPLFLRRRPRADCDPCGTCPLCLL MGRSDTVRRDAKKQKKDWSVHFCNLREATERSFNWKETAIERIVNRVDPSSGKAKD |

TABLE 1-continued

| SEQ ID NO & Protein ID/Contig | Sequence |
|---|---|
| | YMRIWEIDPLVCSQFNGIITINLDTDNAGKVKLLMAAGLAQINILAGSICRADIISEDHD<br>ALIKQFMAIDVREPEVSTSFPLQDDELNNAPAGCGDDEISTDQPVGHNLVDRVRISKIA<br>ESIEDVESQEQKAQQLRRMADAIRDLRRSKPDETTLDALPKGKTDKDNSVWDKPLKK<br>DILPSPRMPASEDDDTPTLRKVLKDEINGQEDMWRKFCEALGNSLYDLSKKAKERKR<br>TEALPRLLGETEIYGLPMRENKEDEPLPSSLTYKFKWLIAGELRAETPFFFGTEVQEGQ<br>TSATILLNRDGYFRLPRSVIRGALRRDLRLVMGNDGCNMPIGGQMCECGVCRVMRHI<br>VIEDGLSDCKIPPEVRHRIRLNCHTGTVEEGALFDMETGYQGMTFPPFRLYCETENSDL<br>DSYLWEVLNNWQNGQSLFGGDTGTGFGRFELTEPKVFLWNFSKKEKHEAYLLNRGF<br>KGQMPVQDVKTKSFKTKTWFQIHRELDISPKKLPWYSTDYRFNVTSPLISRDPIGAML<br>DPRNTDAIMVRKTVFCPDPNAKNRPAPATVYMIKGESIRGILRSIVVRNEELYDTDHE<br>DCDCILCRLFGSIHQQGSLRFEDAEVQNSVSDKKMDHVAIDRFTGGGVDQMKFDDYP<br>LPGCPAQPLILEGKFWVKDDIDDESKSALEKAFADFRDGLVSLGGLGAIGYGQIGDFE<br>LIGGSADWLNLPKPEENRTDVPCGDRSAQGPEIKISLDADKIYHPHFFLKPSDKNVYRE<br>RELVSHAKKKGPDGKSLFTGKITCRLSTEGPVFIPDTDLGEDYFEMQASHKKHKNYGF<br>FRINGNVAIPGSSIRGMISSVFEALTNSCFRVFDQERYLSRSEKPDPTELTKYYPGKVKR<br>DGNKFFILKMKDFFRLPLYDFDFEGEAESLRPNYDEDRNEEENKGKNKNTQKVKNAV<br>EFNIKMAGFAKHNRDFLKKYKEQEIKDIFMGKKKVYFTAGKHKPNEAHDNDKIALLT<br>KGSNKKAEKGYFKFTGPGMVNVKAGVEGEECDFHIDESDPDVYWNMSSILPHNQIK<br>WRPSQKKEYPRPVLKCVKDGTEYVMLKRSEHVFAEASSEDSYPVPGKVRKQFNSISR<br>DNVQNTDHLSSMFQSRRLHDELSHGDLVYFRHDEKRKVTDIAYVRVSRTVDDRPMG<br>KRFKNESLRPCNHVCVEGCDECPDRCKELEDYFSPHPEGLCPACHLFGTTDYKGRVSF<br>GLGWHESNTPKWYMPEDNSQKGSHLTLPLLERPRPTWSMPNKKSEIPGRKFYVHHP<br>WSVDKIRNRQFDPAKEKQPDDVIKPNENNRTVEPLGKGNEFTFEVRFNNLREWELGL<br>LLYSLELEDNMAHKLGMGKALGMGSARIKAEAIELRCESAGQNAELKDKAAFVRKG<br>FEFLEIDKPGENDPMNFDHIRQLRELLWFLPENVSANVRYPMLEKEDDGTPGYTDFIK<br>QEEPSTGKRNPSYLSSEKRRNILQTPWKHWYLIPPFQASAQSETVFEGTVKWFDDKKG<br>FGFIKINDGGKDVFVHHSSIVGTGFKSLNEGDSVAFKMGVGPKGPCAEKVKKIGN |
| SEQ ID NO: 18<br>Ga0073580_<br>1036305 | MTKIPISLTFLEPFRLVDWVSESERDKSEFLRGLSFARWHRIKNQREDENQGRPYITGT<br>LLRSAVIKAAEELIFLNGGKWQSEECCNGQFKGSKAKYRKVECPRRRHRATLKWTD<br>NTCSDYHNACPFCLLLGCLKPNSKENSDIHFSNLSLPNKQIFKNPPEIGIRRILNRVDFT<br>TGKAQDYFYVWEVEHSMCPKFQGTVKINEDMPKYNVVKDLLISSIQFVDKLCGALC<br>VIEIGKTKNYICQSFSSNIPEEEIKKLAQEIRDILKGEDALDKMRVLADTVLQMRTKGP<br>EIVNELPRGIEKKGGHWLWDKLRLRKKFKEIANNYKDSWQELCEKLGNELYISYKEL<br>TGGIAVKKRIIGETEYRKIPEQEISFLPSKAGYSYEWIILGKLISENPFFFGKETKTEEQID<br>MQILLTKDGRYRLPRSVLRGALRRDLRLVIGSGCDVELGSKRPCPCPVCRIMRRVTLK<br>DARSDYCKPPEVRKRIRINPLTGTVQKGALFTMEVAPEGISFPFQLRFRGEDKFHDAL<br>QNVLVWWKEGKLFLGGGASTGKGRFKLEIEHVLKWDLKNNFHSYLQYKGLRDKGD<br>FNSIKEIEGLKVETEEFKVKKPFPWSCVEYTIFIESPFVSGDPVEAVLDSSNTDLVTFKK<br>YKLEESKEVFAIKGESIRGVFRTAVGKNEGKLTTENEHEDCTCILCRLFGNEHETGKV<br>RFEDLELINDSAPKRLDHVAIDRFTGGAKEQAKFDDSPLIGSPDSPLEFTGIVWVRDDI<br>DEEEKKALKSAFLDIKSGYYPLGGKKGVGYGWVSNLKIESGPEWLRLEVQEKSSQEN<br>VLSPVILSEVMDIEFNPPKIDENGVYFPYAFLRPLNEVKRTREPIGHNEWKKSLISGYLT<br>CRLELLTPLIIPDTSEEVIKEKVNNGEHPVYKFFRLGGHLCIPAAEIRGMISSVYEALTN<br>SCFRVFDEKRLISWRMTAEEAKRPDPKKSEEQNRMRFRPGRIIKKDKKFYAQEMLEL<br>RIPVYDNKDKRNEISQNDPTRPSEYNHPTEPERIFFSNAEKIRNLKRNSNYLHGSTPLL<br>FRQWSISNRYDKIALIGNKSQGHLKFTGPNKIEVSEGTKCPKYETIPGRDEWDKAVHN<br>YVEPGKFVTVISRKKGQKPKAVQRRRNVPAFCCYDYNTNRCFVMNKRCERVFKVSR<br>DKPKYEIPPDAIRRYEHVLRKYRENWERYDIPEVFRTRLPGDGETLNEGDLVYFRLDE<br>NNRVLDIIPVSISRISDTQYLGRRLPDHLRSCVRECLYEGWGDCKPCKLSLFPEKMWIR<br>INPEGLCPACHLFGTQVYKGRVRFGFARAGSNWKFREEQLTLPRFETPRPTWVIPKRK<br>DEYQIPGRKFYLHHNGWEEIYKKNKNEIKKEKNNATFEVLKQGTFYFKVFFENLEL<br>WELGLLIFSAELGGEEFAHKLGHGKALGFGSVKISVDKIILRRDPGQFEQRGQKFKRD<br>AVDKGFCVLENRFGKTNFKIYLNNFLQLLYWPNNKKVKVRYPYLRQEDDPEKLPGY<br>VELKKHQMLKDDNRYSLFARPRAVWLKWTEMVQRDKS |
| SEQ ID NO: 19<br>Iso3TCLC_<br>1001005823 | MSVEEFYVRLTFLEPFRVVPWVRNGDERKGDRIYQRGGTYARWHKINDSHGQPYITG<br>TMLRSAVLREIENTLTLHNTYGCCPGGTRTTEGKLEKPLYLRRRDGFEFENHAEKPCS<br>EEDPCPLCLIQGRFDKLRRDEKKQFVRQGNISFCSVNFSNLNISSGIKSFSWEEIAVSRV<br>VNRVDPNSGKAKDFFRVWEIDHKLCPNFLGKMSISLSEKLEDVKALLAVGLAQVNVL<br>SGALCRVDIIDPETQKDTVHQHLIQQFVTRIQDKEKGDAADIPAFTLPPAGLSPSSNEW<br>NDTIKSLAEKIRKIKELEQGGQKLRQMADVIRELRRKTPAYLDQLPAGKPEGRESIWEK<br>TPTGETLTLRQLLKSANVPGESWRAFCEELGEQLYRLEKNLYSHARPLPRLLGETEFY<br>GQPARKSDDPPMIRASYRAFPSYVWVLDGILRAETPFYFGTETSEGQTSQAIILCPDGS<br>YRLPRSLLRGVIRRDLRAILGTGCNVSLGKVRPCSCPVCEIMRRITVQQGVSSYREPAE<br>VRQRIRSNPHTGTVEEGALFDLETGPQGMTFPFRLYFRTRSPYIDRALWLTINHWEG<br>KAIFGGDIGVGMGRFRLENLQIRSADLVSRRDFSLYLRARGLKGLSREEVTRIGLNEE<br>QWEAVMADDPGTHYNPFPWEKISYTLLIHSPLISNDPIAAMLDHDNKDAVMVQKTVL<br>FVDESGNYSQMPHHFLKGSGIRGACRFLLGRKDAPNENGLTYFEADHEECDCLLCSL<br>FGSKHYQGKLRFEDAELQDEVEAIKCDHVAIDRFHGGTVHRMKYDDYPLPGSPNRPL<br>RIKGNIWVKRDLSDTEKEAVKDVLTELRDGLIPLGANGGAGYGRIQRLMIDDGPGWL<br>ALPERKEDERPQPSFSPVSLGPVHVNLKSGSDTADVYYHPHYFLEPPSQTVSRELDII<br>SHARTRDSGGEALLTGRILCRLITRGPIFIPDTNNDAFGLEGGIGHKNYRFFRINDELA<br>IPGSELRGMVSSVYEALTNSCFRIMEEGRYLSRRMGADEFKDFHPGIVVDGAKIREMK<br>RYRLPLYDTPDKTSRTKEMTCPELFTRKDGRPERAKKFNEEIAKVAVQNRAYLLSLD<br>EKERREVLLGNREVTFDECPDDEYSDDEYSELKYAQKYKDFIAVLKKNGQKRGYIKF |

TABLE 1-continued

| SEQ ID NO & Protein ID/Contig | Sequence |
|---|---|
| | TGPNTANKKNEDAPDKNYRSDWDPFKLNILLESDPECRVSNIHCYPRPLLVCIKDKAE YRIHKRCEAIFCSIGSPSDLYDIPQKVSNQYRTILQDYNDNTGKIVEIFRTQIKHDQLTT GDLVYFKPAANGQVNAVIPVSISRKTDENPLAKRFKNDSLRPCAGLCVEDCNECPAR CKKVADYFNPHPRGLCPACHLFGTTFYKGRVRFGFAWLTGEDGAPRWYKGPDPCDS GKGRPMTIPLLERPRPTWSIPDNSFDIPGRKFYVHHPYSVDGIDGETRTPNNRTIEPLAE GNEFVFDIDFENLRDWELGLLLYSLELEDSLAHKLGLGKPLGFGTVQINIRGISLKNGS KGWDTKTGDDKNQWIKKGFAHLGIDIKEANERPYIKQLRELLWVPTGDNLPHVRYPE LESKTKDVPGYTSLLKEKDLADRVSLLKAPWKPWKPWSGTAPHPDKGTNRLRASIVE RDRIQRKTDTAKPEKKEETKVGKSSSSDIEKRYVGTVKWFNDKKGYGFILYGTDEEIF VHRSGVADNSIPKEGQKVGFRIERGARGSHAVEVKAIE |
| SEQ ID NO: 20 SESD01000293.1 | MPRFQLSLTFFDEPFRLIEWTDKSNRNSANTQWMRGQGFARWHKITLEKGFPFVTGT AVRSKIIREVEALLSRNKGTWNGIPCCSGFFDTKGPSPTHLRYRPTLEWEYGKTVCTSE ADVCPLCLLLGRFDQAGKKSDTPCQSTDYHVHWENLSAGVAQYRLEDIAQKRTSNR VDFFSKKAHDHYGVWEVTAVKNLLGYIYISDAITESHQKTVISLLKAALSFTDTLCGA NCKLELSDEPVDSIHSNQSASNFNPHSGAAPSQCSQSMPPFNMDQETKELANTLCKAF TGNMRHLRTLADAVREMRRMSPGISSLPRGRLNKEGEITAHYLWDERIDEKTIRQVLE DTIELSPARSIIYKNWISFCNQLGQKLYERAKDNDPILERKRPLGEAAFSKVPTSSHAPR HDMNSRVKGGFTREWIIVGTLRALTPFYMGTGSQAGKQTSMPTLQDSNDHFRLPRTA LRGALRRDINQASDGMGCVVELGPHNLCSCPVCQVLRQIRLLDTKSKFSMPPAIRQKI CKNPVLSIVNEGSLFDVELGIEGETFPFVMRYRGGAKIPDTIITVLSWWKNERLFIGGE SGTGRGRFVLECPRIFCWDVEKGQNDYIQYHGFRNKEDELLSVYSTVSGLAEKNDVN LNNARDFSFDKICWEVQFDGPVLTGDPLAALFHGNTDSVFYKKPILKSGEKEPSYQW AIKSDTVRGLIRSAFGKRDALLIKSHEDCDCLLCEAFGSKHHEGKLRFEDLTPKSDEIK TYRMDHVAIDRISGGAVDQCKYDDEPLVGTSKHPLVFKGMFWINRDSSVEMQRALIA AFKEIRDGLYPLGSNGGTGYGWISHLAITNGPDWLNLEEVPLPQPTADIPVEECTAEPY PKFQKPDLDQNAVYYPHYFLQPGKPAERERHPVSHDHIDDKLLTGRLVCTLTTKTPLI IPDTQTNTMLPPNDAPEGHKSFRFFRIDDEVLIPGSEIRGMVSTVFEALTGSCFRVINQK AHLSWRINADMAKHYRPGRIIQNNEKMFIQPYKMFRLPFYAGFDPRNCLSEKQLLGIE PVKLWVKDFVASLVKPQTDIDIEWKEKIGFVRVTGPNKVEVDSSNTPDPSLPECESDW KDIHITEDGSTPSKNDRVYRCQLKGVTYTVAKWCEAFWVKDEGKKPITVNAEAINRY HLIMKSYQDNPQSPPIIFRSLPVLNYKQDQKIIGSMIFYRESAKSDKIVNEIIPVKISRTA DTELLAKHLPNNDFLPCAATCLNECDTCNAKTCKFLPLYREGYPVNGLCPSCHLFGTT GYQGRVRFGFAKMNGNAKFCQGGERPEDRAVTLPLQERPKLTWVMPNENSTIPGRK FFLHHQGWKKIVDEGKNPINGDVIEPDANNRTVEPLAAGNDFSFEVFFENLREWELGL LRYTLELESELAHKLGMGKAFGFGSVKIKIKSVDLRKQGEWEKATNTLVSEDKKSSW YNIHTVNNLRTALYYVEDDKIQVNYPKLKKDNESDNRPGYVEMKKTAFPVRDILTTP WWPWWPPTPPPMNQSGNQSYARSEEPARITESQPEVYKTGTVKFYKHDKKFGFITM DGRENIHFAGNQICRPETSLQSGDKVKFIEGENYKGPTALKVERLKG |
| SEQ ID NO: 21 OBJA01001127 | MRLKINIHFLEPFRLIEWHEQDRRNKGNSRWQRGQSFARWHRRKDNDQGRPYITGTL LRSVVIRAVEEELARPDTAWQSCGGLFITPDGQTKPQHLRHRATVRARQTAKDKCAD RQSACPFCLLLGRFDQVGKDGDKKGEGLRFDVRFSNLDLPKDFSPRDFDGPQEIGSRR TINRVDDETGKAHDFFSIWEVDAVREFQGEIVLAADLPSRDQVESLLHHALGFVDRLC GARCVISIADQKPAEREERTVAAGDEKATIADYDQVKGLPYTRLRPLADAVRNLRQL DLAELNKPDGKFLPPGRVNKDGRRVPHYVWDIPLGKGDTLRKRLEFLAASCEGDQA KWRNICESEGQALYEKSKKLKDSPAAPGRHLGAAEQVRPPQPPVSYSEESINSDLPLA EWIITGTLRAETPFAIGMDAPIDDDQTSSRTLVDRDGRYRLPRSTLRGILRRDLSLASG DQGCQVRLGPERPCTCPVCLILRQVVIADTVSETTVPADIRQRIRRNPITGTAADGGLF DTERGPKGAGFPFSLRYRGHAPMPKALRTVLQWWSAGKCFAGSDGGVGCGRFALD NLEVYRWDLGTFAFRQAYSENNGLRSPEEEFDLAVIHELAEGLAKEDGQKILKGTEPF TCWQERSWQFSFTGPLLQGDPLAALNSDTADIISFRRTVVDNGEVLREPVLRGEGLRG LLRTAVGRVAGDDLLTRSHQDCKCEICQLFGSEHRAGILRFEDLPPVSPTTVADKRLD HVAIDRFDQSVVEKYDDRPLVGSPKQPLVFKGCFWVQTSGMTHQLTELLAQAWRDI AAGHYPVGGKGGIGYGWINSLVVDGEKITCRPDGDSISLTTVTGDIPPRPALTPPAGAI YYPHYFLPPNPEHKPKRSDKIIGHHTFATDPDSFTGRITCKLEVVTPLIVPDTEGEQPKD QHKNFPFFKINDEIMLPGAPLWAAVSQVYEALTNSCFRVMKQKRFLSWRMEAEDYK DFYPGRVLDGGKQIKKMGDKAIRMPLYDDSTATGSIKDDQLISDCCPKSDEKLQKAL ATNQKIALAAKHNQEYLAQLSPDEREEALQGLKKVSFWTESLANNEAPPFLIAKLGEE RGKPKRAGYLKITGPNNANIANTNNPDDGGYIPSWKDQFDYSFRLLGPPRCLPNTKG NREYPRPGFTCVIDGKEYSLTKRCERIFEDISGGENQVRAVTERVREQYREILASYRA NAAGIAEGFRTRMYDTEELRENDLVYFKTAKQADGKERVVAISPVCISREADDRPLG KRLPAGFQPCSHVCLEDCNTCSAKNCPVPLYREGWPVNGLCPACRLFGAQMYKGRV NFGFARLPDDKQPETKTLTLPLLERPRPTWVLPKSVKGSNTEDATIPGRKFYLRHDGW RIVMAGTNPITGESIEKTANNATVEAIMPGATFTFDIVCENLDQQELGLLLYSLELEEG MSHTLGRGKPLGFGNVRIKVEKIEKRLSDGSRREMIPPKGAGLFMTDKVQDALRGLT EGGDWHQRPHISGLRRLLTRYPEIKARYPKLSQGEDKEPGYIELKSQKDENGVPIYNP NRELRVSENGPLPWFLLAKK |
| SEQ ID NO: 22 OBEQ011807420 | MSNQTRWIIEGTLELITPLHIGTGLDEKERDENKETRWLEAVALDHKGQPYIPGASLK GALRALAKRHDFRNLFDNKEVDGDFVRQAEFLSAWCVPDTDKGLIQPRVAIDRVT GTAQDKKLFQTRLITPGTRFAMKIVVQNAVENEIADLLGLLNLLPDDPQFSLGAYANQ GQGRVQWFGKIQTRCFGINEAKAWYEEIRKDESKCWTAFAKPKNVSTPPTPAKEAQL TLPLNLAFHTPFLVKQAGIKADDADAVPRRTHDDKIVLPASSLRGRLRTQSERILRTLG CETPQGHTAPAYRKGQPHDDLAVLLFGAAGWRGIVQTSDCIVEDKSIKTRRHEMLAI DRFTGGGKDGAKFNVDYVECPTLAGKLSLDLARLKNAKLKGGKDALLPALGLMTL |

TABLE 1-continued

| SEQ ID NO & Protein ID/Contig | Sequence |
|---|---|
| | MLRDLAEGDIPFGYGISKGYGQCRASSALGDWAELLKQHLGADSADTTVQALREYL GNPKGQELKLDPPSADATQAGVPAQQNAAKTQAQGAQEKFHNPYHFIPLSKPDISQW PEPQKLTEKGHSHDRYASLSGRIVCRLTTQTPLFIGSEQTTPTNPQAPKSLHPFKLNNG LAIPATSLRGMISSLFESVSNSNFRVLDEKTYSMRKTMQQSLSAMGRIVRHDQKLYLL PLTLPTLPQGPHGVYDLGEKWSAVFDWQPPPLRIYFDPPPRRTYQSQQPCYMKLSTV KYSESNPNQIIAGENLGALRFPRGNQNTQFLIGQSNQDECPITQAEYAQKSEDERNEYT SGWVRTLVKPGRDLPRSVKHHVFLPDVFIDAPPPVNDLYPIPDSVIQRFHDLADQVLA SMNLKPEEIVDSTNLLPYTPVGRRSDSDCRDTRLQAGDLIFFDIDPPLHPGEKSQITEISF SSIWRSGIGKDHLLTTPDLLTNFDVNLQPHGMPGRTQSLSPAELLFGLVGTQNDQATT AYAGKVRIGFGLPEEGHNPRLDARITLKELSSPKPPSPALYFRKKSGKDEYVSKANLA DKPEDYILRGRKMYLHAWRKNEQVVELSDTGHDGGVRPPWVSKFDESADEGNKRR VSIEPIAKDESFYFEVDFHNLSRTELAQLCATLYPNEKFEHRLGMGKPLGLGSIKITPLS LFLVNRSQRYATDGLDKPRYHAVWHTGTASEPRWPDHLREQQGIAFEGVSTAPTV MSLAAEAKVSDDVKRALELLGNPDEITVPVHYPQLHNGLMESKQFDWFVQNDKSGR DQPANNRQHLSSFTKDTEKLEPLIRIMRR |
| SEQ ID NO: 23 OVOO01000106 | MTTPSAPKSSLPALHWLIRAELEVLTPLHLGTGTDQRITPDAPDADPYWQADIALDAD GRPYLPGASLKGALKALARRRQVDAPCLPLFGDLNRGGAPHPDCIPPRRTRAGLAEFR DALQSHATQADGPDTAQPRIAIDRITGSVVDKKLFHTQTVPVGTRFSVEIILRRADQNL AAQLVALLQHGPTDPDFRLGAHANLGFGRVGLYGNIDTRRFGPQQAQHWFAAAQTQ ADARWTDFAEAVTLTAPAPAPAQPAPHRLALPLSLTFHTPFLVKQPEHKHRKPQDNA PDGTPRQRGDRALLPGASLRGRLRSQAERILRTLGCKVAQGHAVPPVKNNTCPDPAT LLFGTAGWRGLLRTDDCTGTAPATLVDHDMLAIDRFTGGGKDGAKFKLRYAECPTL EGQLSLDLSRLRSARLDGANAADTPWIALGLLTLVLRDLAEGDIPFGHGSAKGYGRC RAQGLPDRWRQALEAHFGPNADARALAALRAWCRTHATAALDAPCSLAGSAPTPA AAAPSGQAAPADAFHNPYHFIPFSQPDIDRWLSPDAHRKTGGHSRYRGLSGRLVCAL TTVTPLFVGAAARTPASDQHPKPVAGFALQNQPAIPATSLRGLLSSLFESISGSNLRVL HPTPYSIRKTTKEALSAIGRIVERNGELKLYPLTLPTIHQNADNAYPVPARWRKVFYW ESPVPLRVYFGSRKQTYDSRQPHYLPIQELSYLPNDSDCIAPDQGDLRFPSRDRDRKFL IGQCPISRYDCPIPETDLPKLSPQERPRYTRGWVRSLWTSNREKELPHTVKHQLFIPDP VETPAADDLLPIPQGVLDTFHALADLALAGQHWGKDETPADDQLLPFTPAGRQRHD ADRPPRDADRQTRLQPGDLVCFDLGDDGAVSEISFSSIWREGLRLAGKPNLATTADLL AQVSPHLLPLGMPGRSARLSPVEQLFGVVEYRPPQTAKGTRKPTDAPAAYALAGKLQ VGFGRPARPFEREPAVTLKELSTPKPPSPALYFRPKAGDGYVSKAKLASQPQDYAPAG RKHYLHALRRQGQVARLDNSGHVPSDGSGRPPWQSRFDGQEDSGNKRRVREPIPA GETFHFEIDFDNLSPTELEQLCATLLPHPAFEHRLGMGKPIGLGSVKLAVEGLLLVDRP RRYAEDEPNAPRHHRGWRANADAGWPDHLQGDSPAAPLEATEQPAALAERAMARV PADVRRALQLLGNPGAVAAPVHYPQVKDAQIEEKHYLWFVANDDEKTAGGNRHLP RLHANSPGLPTLPRLVKREKDHSSNTGKPRRK |
| SEQ ID NO: 24 PDWI01005922.1 | MIPDLRSLVVHISFLTPYRQAPWFPPEKRRNNNRDWLRMQSYARWHKVAPEEGHPFI TGTLLRSRVIRAVEEEELCLANGIWRGVACCPGEFNSQAKKKPKHLRRRTTLQWYPEG AKSCSKQDGRENACPFCLLLDRFGGEKSEEGRKKNNDYDVHFSNLNPFYPGSSPKVW SGPEEIGRLRTLNRIDRLTTKAQDFFRIYEVDQVRDFFGTITLAGDLPRKVDVEFLLRR GLGFVSTLCGAQCEIKVVDLKKKQNNKEDSILPVSEVPFFLEPEVLAKMCQDVFPSGK LRMLADVILRLREEGPDNLTLPMGSQGLGGRLPHHLWDVPLVSKDRETQTLRSCLEK IAAQCKSEQTQFRLFCQKLGSSLFRINKGVYLAPNSKISPEPCLDPSKTIRTKGPVPGKQ KHRFSLLPPFEWIITGTLKAQTPFFIPDEQGSHDHTSRKILLTRDFYYRLPRSLLRGIIRR DLHEATDKGGCRVELAPDVPCTCQVCRLLGRMLLADTTSTTKVAPDMRHRVGVDRS CGIVRDGALFDTEYGIEGVCFPLEIRYRGNKDLEGPIRQLLSWWQQGLLFLGGDFGIG KGRFRLENMKIHRWDLRDESARADYVQKCGLRRGVGDDTAINLEKDLSLNLPESGY PWKKHAWKLSFQVPLLTADPIMAQTRHEEDSVYFQKRIFTSDGRVVLVPALRGEGLR GLLRTAVSRAYGISLINDEHEDCDCPLCKIFGNEHHAGMLRFDDMVPVGTWNDKKID HVSCSRFDASVVNKFDDRSLVGSPDSPLHFEGTFWLHRDFQNDVEIKTALQDFADGL YSIGGKGGIGYGWLFDMEIPRSLRKLNSGFREASSIQDALLDSAKEIPLSAPLTFTPVKG AVYNPYYYLPFPAEKPERCLVPPSHARLQSDRYTGCLTCELETVSPLLLPDTCREKDG NYKEYPSFRLNNTPMIPGAGLRAAVSQVYEVLTNSCIRIMDQGQTLSWRMSTSEHKD YQPGKITDNGRKIQPMGKQAIRLPLYDEVIHHVSTPGDTDDLEKLKAIVLELTRPWKE LPEEQKKKRFEKCKNILDGRMLQQKELRALENSGFAYWRDKTSLTFDSFLKDAIEQE YPRYSGDYQRIKALVVNITLPWKLLKKEERHKRFDKCRRILKGQQPLTKDERKALEES GFANWHGRELLFDRFLKDENSCLIKAETTDRVIASVAKNNRDYLFEIKQQDFARYKRI IQGLERVPFSLRSLAKSKETSFQIACLGLRRGRFLRKGYLKISGPNNANVEISGGSHSNS GYSDIWDDPLDFSFRLSGKSELRPNTQKTREYPRPSFTCTVDGKQYTVNKRCERVFED SAAPAIELPRMVREGYKGILTDYEQNAKHIPQGFQTRFSSYRELNDGDLVYYKTDSQG RVTDLAPVCLSRLADDRPLGKRLPEEYRPCAHVCLEECDPCTGKDCPVPIYREGYPAR GFCPACQLFGTQMYKGRVRFSFGVPVNSTRSPQLKYVTLPSQERPRPTWVLPESCKG KEKDVPGRKFYLRHDGWREMWGDDDKPDSRPSSEECQDIIEGIGPGEKPHFRVAFEN LDKNELGRLLYSLELDAGMNHHLGRGKAFGFGQVKIRVTKLERRLEPGQWRSEKICT DLPVTSSELVISSLKKVEERRKLLRLVMTPYKGLTACYPGLERENGRPGYTDLKMLAT YDPYRELVVQIGSNQPLRPWYEPGKSFKPSPGNDCTGRGGSVSKSLISEPKVVPAIAPF CEGVVKWFNSVKGFGFIETKEQRDIFVHFSAIRGEGYKILEPGEKVRFEIGEGRKGPQA INVIRIR |
| SEQ ID NO: 25 VAPF01001339.1 | MKMNKTWPFREHWEISGYLRTVTPLHIGSGRTVTRPELTVADRDELVDINAVVTDYT GKPYLPGSTIKGALHAWLQKRLKEESRTCLIQLFGQEEEAEEKKKNNHGGKAEFFDA RVIFPHTGPGSLPYWDDCRQTYVAATVAIDNITRTARHRHLIHAEMVPPGVTFALTLA |

TABLE 1-continued

| SEQ ID NO & Protein ID/Contig | Sequence |
| --- | --- |
| | GPLDEEDIGLLLAALQGFNESPPALVIGAHTANGLGRFSWELSTVRRFGKEHLQGWLE<br>AETRAMRTEAMQPLSREGVEDLLQDGIAQIDHNEDQVRLGLELCFDGPFLVNDPPTK<br>KEQDDKKKRRSNTPNLRPLRDAIGRPCLPESSVRGALRAQAERIIRTMEGTCSEDNPA<br>YKKEIHTDAEIEELSAVCRVFGAPGWKSLLEISDFEFVDGEDCDNIQEFVAIDRFTGGA<br>KDKAKFNAEYIGSPRFTGTIALDKRRDLPDWGKGLLYLVLRDLAEGDITLGFGRSKG<br>YGVCRAKIKNLDLLLPEKSVAALHKKFAISPADDKPATDQIAEDTTSGNLGISAGGPA<br>QKTTESYEPPNPSGPGTFHNPYHFVPVVKPSAADRQHWLDKGILPSASENKTQHTHA<br>CYLDTTNGKKIYHGRIVCRLQAETPMFIGGRHRENTEPTEILPFTLGGKPAIPATSLRG<br>MLSSIAEAASNSSLRVLEDKTLSYRKSMRANRNEDKPLSALGMIKKIETGDKVEYRLL<br>PLTLPTLVKRGQYYILPEEYQTMFPDGRAKLKVYLNSNYTASDGTNQDFLKGKKSWR<br>LPHGEIYYMKLCQDFSLQNGQLTFDSQNQNMLHFPKNRNNFVVGQRSIDNTPPMTKA<br>EWRTNHQTGVPGMLRIMQASGRNFPTGRYHEIFIPVPTKKDCKQLYPVDEKAVERFL<br>DLAGEQTKSQQNEKNLKQYQILPYHPVGTKRNTDPETNDRYMDLNSGDIVYFRPDAT<br>GTKVEEISFSSIWRDRVEDDNHNRAGVHAFFGNIDKELLPFNPKRAEISPAELLFGFVE<br>ERERGKVDDGQAPAFAGKVRVSFGRLSSEKKPDTIFQDQVTLKALSSPKPPSPALYFT<br>GNGNGSIAKPDLTLSRHSPQGRKFYLHAWQEENEIIKFLSNGKKTSPTVINGLYPWES<br>KSNLSRQLPDKHAKLKSAITPIKKGTVFYFHVDFDNLSEWELGLLCYALQPGKEFRHK<br>LGMGKPIGLGSIHIEPAGLYLVHRGNRYSLDGVPDNSRYNGGIWQSEDKRLQEWQEL<br>YPRESTAAASSAAASPADFALKFSGTMTPSVQQALKRLGDPDNVVAPVHYPQVEGA<br>DLEEETYKWFVANDVGSQTKVGNRTTCTEEAARKSMLPLAGRGPLPRLKRYKWCP |
| SEQ ID NO: 26<br>DRKI01000155.1 | MAAVQDRWTLMDQQGNELKRFRITAELETASSLHIGASETVEHDLIKNDDGTPVQIN<br>ALITGAGGLPIIPGSTIKGRFLARLRERGVDSALLETLFGKGHDRETEDQGRGGRAEFH<br>DAPLCHRLSGARHFPYWRPERQIWVKAQTAVDRHRGTALRRSLRYTEMVPPGVRFR<br>LTITGCMTDAEADVLFALLEDLGDPRQACSFGGAGADGNGTMRLFGRPEVYCLDRS<br>GILGWLASFEKGGNGGMAMTAAALLQADTVQRRADKVRQAWQPPDVGPRLHVELR<br>FSGPFLVNDPSRNTPDITQAPDMVPLVDEDGNPMLPASSFRGALRAQAERIIRTLGGRC<br>CDTSSPCRPLGSSDKVGELCLACQVFGAPGWGTTLHIQGFTCTSVFRREQEQTFVAID<br>RFHGGCKEGALYTIRHAESPRFEGHLVIDPRMPAWGRGLLAVFRDLREGDITFGLGA<br>GKGYGVVDAAVVQDMAELEPYVEAFREQCRQHQGMADCHSAPSPQPLRDHDLAEIP<br>PAEEAPGETFLNPYHFVPIREPDTGSWLARDELDSSCCHSHGFYRQQVDDRPLYHGRL<br>TCLLETETPLFIGATGDSSVPSRIENYRLGNRIAIPAASLRGMLSSLAEAASNSAMRVL<br>HQGILSYRKKAKNALREIGMIVLRDGKRFILPLVPLMEVTKLRHAYTDPAMKHFLDD<br>KNSWSPRCNRVYYLGRDGNQIPAETRGAGMRPGILRLLGREGRHDALQNKKHEYFIE<br>IPERYVDQDHCFDYRMFIRDRARNGTLVPISPVAWERYHCLAEERTLSQKNDPELRED<br>KACASLKWLPFHPKGRVRERDPENDVCHLSLRHGDLVFYAEQNRVVSEISFSAIWRS<br>RVETSDSYQAVTVDCFVPKELRPFNRDRRAISPAELLFGFVELDESEHSTEKSRYEQM<br>AFAGKVRLSAGLPVEDVEDSALLEPKPIVLKALSSPKPPSPPFYFVMRDGSGAYIAKK<br>DLSPDRHRIKGRKHYLHGLRQRGNPDRVQSLDRYGHATETAANPPWETCHPEERPQI<br>KVRVQPVRRKTKFFFHLDFSNLSRWELGLLCYVLRPTACFRHKLGMGKPLGLGSVRI<br>DIASLQLIDRVRRYGTDDLTAGRYNMGGHFNASCLDLLPQQDSPAPDDSGAAPDPGT<br>LRQDFVKTMDETVFRALDLLGNPAHVQRPVHYPQVREMDIEDQTFLWFVNDKQW<br>KDALQPLTSSSTQLPPLTRRNKR |
| SEQ ID NO: 27<br>DRNY01000543.1 | MTTVKEKSWAFTGLKRWKIITTLETQTPLHIGSGEVAEIEINDSQGDRRQVQANAIIRG<br>KDDDKPIIPGSTLKGKLRSHFESCLDHSKALERVFGKEYQSDEEQGRGGLAEFHDAVCS<br>YVAPGNSYYPNWNEARNTYIEASTTIDCHTGTAADATLHYNECVPPGTRFLVTVTGA<br>MSDKDAALIVAALQAFGDETNPIHLGAEEANGKGRMGLFGNVEVSCLDHDDIIAWIS<br>QGSDARMATDKFKPLGKEKVNDLAKNITTPTATGGAQRQHFGIELKFDGPFLVNDPS<br>KYSKGDGDQPAVHQPLTDRSNNPILPARSFRGAIRAQAERIIRTMGGACCDTQSPCGN<br>SGQLCIACQMFGTTGWKTTLSISDFTYDGEYRPAKTQQFVAIDRFHGGGKDGALFSIK<br>YFERPVLKGGISLKLRNQNADELSWRKGLLALLFRDLQEGDITFGFGANKGYGVEE<br>ACITNADVISTADIEAFRAKCHANHADSWCSPVSKPTNRDDKSSLPSINPATGAGHAF<br>HNPYHFIPIKAPDTSTWLDKHKLATPGSPHSHAYYRSCSDDDKPLHHGRITCKLTAET<br>PLFVGSGDAENQLTDSEAKLKEHYQLNNKLAIPATSLRGLISSLAEAASNSALRVLDN<br>GVLSYRKPASRALRKIGILFKREEQWRLVQMEGNLANAIKLKSAYTNQKMMDFLAN<br>KQSWSPEHNVVYYLSADFRPGDVPQETYLAGRICGILRILGGKDGDRKNELENKKHE<br>LFIRVDEQYVDTEINRFDYEEYVRQGGIPVSPSAVERYTELADQRSLSQKNSRDLKGD<br>NNCCSDKWLPFHLKGAARYKKEKACLLPLREYDLVYFDSDGTQVTEISFSAIWRDRV<br>ADKVHAFFPEELRPFNQKRKWISPAELLFGFVELNDNKDERDHAQAFTGKVRVAAG<br>VLSPDDSIRQGDLQEHEPIMLKALSSPKLPSPALYFKQKSGDHRYIAKPDLKKASHQA<br>QGRKIYLHALRDQKDDVQKLNTKGQPANGNGAHLPWKTADEDERPQLKVRIRPLKP<br>GTSFYFHLDYNNLTEWELGLLCYVLQPSETFRHKLGMGKPIGLGTVKIEIATLQTIDR<br>QKRYREAGANEHRHNGSNWVNESLRDELERLPGTVELSPDRQPEAKLRPDELRQSFI<br>ATMDNDIYRAIELLGDPHNIKYPVHYPQVRNKSIEQENFKWFVANDSGSGDQRKGTG<br>IDAKEEPMRSIDQISTTIPTLNRYEWNGD |
| SEQ ID NO: 28<br>DTXS01000070.1 | MARNNKQYHFIPRWEIKVNLTTRSFLHIGCDEFTDRPGLEIEQKDGSKVKAEINAFIKD<br>SNGKPYLPGSTIKGNIRKWLETNKKADEETCKLFNTLLGFTVKMQDEGCGGSAEFHN<br>AVISSPLEDGNNFPYWDVDLQTSVETSTVIDRVTGTVVDGRLFSTEVVPPEVSFTLIITG<br>AMTEQQVSLLTAVIKDGFAEDCPTPITIGADSGNGFGRFRFDSIHMKCLGTGEVLNWL<br>EDGSQDMAATAMRSLSPDDIEQHIIKGRNYLKSPSVSDTVTIEFGFGAGPFLVNDPSRKK<br>RKEDIDHQPLRDSAGNARLPAKSIRGAMRSQAEKIIRTLGGWCCDPVNPCPSVFSVVEI<br>NDRLCLACRVFGATGWKSRISIQKVEYKGTAESTRQEETVQDFVAIDRFHGGGKETAK<br>FDASFSWRPQYSILMHIPSDLEGWAKGLLALTFRDFKEGDIFLGYGRSKGYGRVDSDS<br>VKPGIDTMLTESNLELFRRKCDDNPGEYPCKTRQPPNLVQPVERNNLTEAADEGSFH |

TABLE 1-continued

| SEQ ID NO & Protein ID/Contig | Sequence |
| --- | --- |
| | NPYHFIPTPKPMIESWLAKEDFDETMHDSHALYRDVDENEEPLYHGKISCTLTTETPV<br>FVGGKHDPRNDTEPQQVDHYTENGEIAIPATTLRGLLSSLSEAASNSSMRVLDDGMM<br>SYRQPVGSGSLSAIGMVVIRDGKKFIYPLALPIFGERDKLPQEYHIMFPYTQKAPLKVY<br>LERAYLAGNMKSFLDKQNSWNLLNEKIFYLPVPEFSFSRVHTMGAENRDVLKISRRG<br>NLILGARLPVNLCPRSKEKALPGDIPGILRILGKEGRDEVPVGKKHELFIPVSDGFASN<br>PRSFIDNLTSKELFKIPDEVVDRFEELADDRTTQQIKHPGNVKNNNQWLPFHLKGCTR<br>NDGLTGKDEKRLRVQEGDLMYFRPSPQSPQVAEISFSAVWRGRVNKTVHNYFPPELV<br>QFNKNREKISPAELLFGFVQQDKHEKSLSFAGKVVLSSGKQLRETESVSRENEVTLKIL<br>ASPKLPSPSLYFKRENYIEGGNYIAKNEMNNSSNIKPRGRKQYLHALSNSEDPKGVQK<br>ISRTGSVDDGGNYPWQSMNNDNIKQKVCIRPVSKDGCFTFEMEFENCTEWELGMLLY<br>ALRPSQQYRHKIGMGKSIGLGTVRIDINNLQFIHRKNRYNAGIIDVPRYNYEAGHDMD<br>YFHNKFADTIMPEIKNSIELLGDPRNVRFPVHYPQVHGADIEDKTYQWFVANDSGTN<br>NGQNGAAYKKNKAEESSLTELDEISNTIPGLERHEWLGR |
| SEQ ID NO: 29<br>JABFST010000317.1 | MALKTWTLNGEERWHISVVLETVTPLHIGSSGEFCYRPELTNADQKPVDINACIKGAN<br>NLPIIPGSTVKGKFNAWLTARQVDTPLLEAIFGKGHNPDDDDQGSGGKVEFHDAWIST<br>KIKDTSTWPYWQVATQTFIDAATAIDRHSRTALDASLHYTECVPPGVQFTLNITGVM<br>QEHEAALIIAALDRFDQHDDQPYFGAGDANGQGQLILVGHLAVKVMGKTEITEWLA<br>HFNNKASDMAMSHARSLGAEDIAGLIKLGQTLLKPVPPTVSLGIQLQFAGPFLVNDPY<br>AVKKLEADPKTKIDHYPLLDNHKKPRLPSASIRGVLRSQAERIIRSLGVHCCDTRDPCP<br>SLYKHQDLSQLCLACQIFGAAGWKSVINISDFTCVDANELKTQEFIAIDRFHGGGKDG<br>AKFNAKHSERPYFQGRITLSPRMANHQLDWGKGLLALVIRDLQEGDLSFGFGANKGY<br>GALESVLITGIDQLQTDAIEAFRRLCVTQAAPQAFITPTSAVVIGDKAPLVVTDKKLPD<br>NSFHNPYHFIPINSPDTRHWLPTETDLAESHHSHAYYRQQPELFHGQLICRLYTETPTFI<br>GASKKDDTLPAELDNYRLNGQLAIPATSLRGMISSLAEAASNSAMRVLDNGLLSYRK<br>DASLALSKIGITFINRQGQWQLIPMEKIKLKNAYSAENMRLFVEQSHSWSPDYNTVYY<br>FSEKAGAFDVPQRTPKPGWQPGILRLLGKEGRSQELENKKHEWFIPVPENYIDKQLNA<br>FKYQEYLKDNSSKAIDIPAPVLNRYNELAYQRTLSQKKDTELVADGDSPAWLPFHLK<br>GQQRQPQMVGKHLVYTLPMTEYSLVYYAATNKVATEISYSSIWRGRVQDDADQAAT<br>VNHFIPDDLLPFNPKRTSLSPAELLFGFTELDPDKHSNDPTRSFAGKVRIGAATLAAYP<br>SNDSDLLAPEHITLKALSSPKLPSPALYFRTLQGNNSNVYIPKHELNPNHHTAKGRKY<br>YLHATRTPDQKRILKLSDQGHPPQNNAVKLPWLSHQETKNLQLKVKIKPIKPKQSFYF<br>QVDFNNLTAWELGLLCYALRPTIDFRHRIGMGKPLGLGSVKIDILALQTLDRQKRYA<br>QDSQDSARYNQHRWVNSSVTDMLAQAGYDVIEPTANPLVPKDLKTLFSQTMAANID<br>RALTLLGEPQHVKQPVHYPQVRDTAIQVRDTAIEEESYQWFVANDNLSDNSSAAKQT<br>LHDITETSEGLPTLIRHQKKKETQP |
| SEQ ID NO: 30<br>PDPY01000001.1 | MSDTQKQAIHENKWHFRGIKRWEISAYLKTLSPLHIGDGGTIPVTIKDTQGKNREVEV<br>NSVITGKAALPIIPGSTIKGRLRHYFSKHFSDKALLNKVFGEESDATDDDQGRGGLAEF<br>HDAKWNPEKNRNLQGRYPYWNNTRKTYIEVSTAINRHTGAAKDKSLHHTECVPPGT<br>VFEIKITGSMDDRCAALVVAALEAIQTTGSRIFLGAEDANGNGRIGLTGKITVKQMDQ<br>AHIIQWLQKDSTTCVASFSNVKAENETQVKQMVQRHIAPKLNSVVSAAGPSYDITLHF<br>DGPFVVNDSDKCKAEDTPDIYPLEEKNGVPAFPVRSFRGAIRSQAERIIRTIGGQCCDG<br>SINNTCKNPKNLCIACEMFGSTGWKTSIEMDPFLCVDRELKPFIIQEFVAIDRFHGGGK<br>DEAKFNAAHYQAPVFKGKVRVSQRVGNDISWRKGLLALIFRDLKEGDIYFGFGTNKG<br>YGAVKKAEINPDGNASDFSESDIEAFINKCREKKGLYNCNPIKPGKTKVSKNLPPAIV<br>PLDRTDSKFYNPYHFIPVKKPNTSSWAEKTAFGTADSPHSGFYRKQTNEQQPLYSGR<br>LICMLTSETPFFIGAQAESDPTENENQASLRHPYQLDGEPAIPSTSLRGLISTMTEAAAN<br>CAMRVLDSEIISYRKPMNPSHILSALGMVTKRGEDFWLIPLAMPALSLNDEEHNYKLD<br>KRYRTMFPDGLAKLKVYLEKAYSNNVMKTFLNNENTWTLAQSKIHYLPLTPIQMQN<br>GGINSYYNNLRTPSRSNNFLIGQTVAHGNGIPASGPGAGMVPGILRILGKEHRQNDLP<br>QNKKHELFIPVPDAFVADPKTFLDTATAFLIPRNVIDAFEKIAEKQTQSQKQDKLKHD<br>EERLPFHLKGTRREQNHTLQIKTGDLVYFRPNAKGDEVEEIAFSSIWRGKTSGTTADFF<br>PDKELLPFNRNRSRVSPAELLFGFTENNPKEMKIDRGLAFAGKIRISAGTLSDKFSDTT<br>ESDLFEPETTLKALSSPKPPSPALYFKEKKSGTQYIKKQDLNPGKHEIQGRKIYLHALR<br>NENNQNVQRITSQGKFDNAANRTQPWVSQNEERNHLKTKCKPLKSGLNFFFHIDENN<br>LTQWELGLLCYALRPCETFRHKIGMGKPIGLGTVKIDIAVLQTIDRYARYTDTTQDSE<br>RYNQGAWISQELQNEIPNQYKGKGISNKKGMLSPEDCRKVEMETMDADIQRAIELLG<br>DPGNVTSPVHYPQLDRKNIETKNYEWFKQNEIEQQVLKPITKNTTHLTPFARWEQG |
| SEQ ID NO: 31<br>NZ_JMLA01000001.1 | MNLPTWKLNNEKRWHISIVLTTATPLHIGSSGEFCEHDDVKNNDGEPVKINACIKGSKG<br>RPIIPGSTIKGKLYEWLKTRNTEENLLEKLFGKGHNSVSQDQGRGGKAEFHDAEIIEPL<br>TGSQPWPYWREEHQAFIAASTAIDRHKQVALQQSLHYMETVPAGIRFKFTFTGVMRD<br>EEAALLIAALDSFDKNQNQPCFGVDRANAYGRMELHGHLHVKVMGATEISSWLNSF<br>SENDKKMAMESARNLEQQEINTLIKQGNALFKASCDEVKLGLTLKFKGPPLVNDPYA<br>VKILSSNENAKTDHYPLLDKNRNPYLPVSSFRGVLRSQAERIIRTLGGKCCSTDDPCKP<br>IFDKGDLSKLCLACQIFGASGWKTVINIHDFKAINKSKKTKQDFVAIDRFHGGGKDGA<br>KFDATHFERPEFEGAISFSPRMANNDLDWGKGLLALVLRDMQEGDMTFGYGANKGY<br>GGLESASITGIEQITSDIQAFRDKCVASPQTWLCDEAVKPANQQDKIPPAGIQVANSGF<br>HNPYQFIPSKDPDTGHWLPVLGLNADSHHSHAFYRDQTDNGEKLYHGRLICCLNTET<br>PIFIGADKKKDTEPAEINNYRLNGELAIPATSLRGMISSLAEAASNSAMRVLDNGLLSY<br>RKTADDALRKVGMVIYVDNKSFIIKLNDAIKLKQTYTPGNMKDFIEKSNSWSPEHNT<br>VYYLDNNQIPQESYMNGMKPGILRILGKEGREQELENKLHELFIPVPLEYVDTENNKF<br>DYQAYKKAFLYRAIEIPEPVLKRYSELADQRTMSQKSNELKKDDTCQSVGWLPFHL<br>KGTKRQLDDKHKVGKLQIDEYDLIYYEASGKEVTEVAFSSIWRGRVETNSSQANKVY<br>SFIPGELLPFNESRKKVSPAELLFGFTQINKDGSKADDKAQAFAGKVRISAGTISEYPES |

TABLE 1-continued

| SEQ ID NO & Protein ID/Contig | Sequence |
|---|---|
| | EANLLEQEVTLKALSTPKLPSPALYFRTINGNGSAYISKQELEPSKHLAKGRKYYLHA LRTGDNKVQKLGSQGETANGGDSKLPWVTHNPDERPQLKVKIKPIKAEFIFSLDENNL TEWELGLLCYALRPTDSFRHRIGMGKPLGLGSVKIDIMALQTINRQQRYAQDGLEEN RFNRHNWVNPPHQPRLDKAGYSISLSSTPLNPEILRATFTKTMNADIYRTLELLGNPQ NVKRPVHYPQVENHNIEQENYKWFVANDQGSGKGRNKIDPAEKALKILTENSDCLPT LSRLDWRDE |
| SEQ ID NO: 32 NZ_FOGH01000010.1 | MNNKGSNMTDTVKSGRWIITGQFQLVTPMHIGTGLDEEMDKQSGESVDKKQNNSWI QAIALDLNKKPYIPGASIKGALKALARRYYCASNLNIFGDTIDTKDGDNKRKSVTVAG QAEFLNAWYAADQEDKPFDTITRVAIDRVTGTAEDRKLFNTRRVNPGVCFNYKIIIQN ACETEIQYLLDLLRKAAKDPSFSLGAGANQSQGKVRCLSSCVRYFGKQEMHDWFRAI QNGKQEHWQIFAKPSNIKYADLERPDIIANSLNLPLTLDFHTPFLVKASKKKDEAKNE ADAKPRTNHQGQVILPASSLRGRLRAQAEKILRTMGQDIPQGHAAPAYDGIAHRDLIS LLFGTAGWKGIVCASDLIHSIPEYALQFNGVRETISDLSDTVKSCIIVDLVKTSTAAEKT EEQLHIRIVDSAGSLIVHKSENSSWANDTFRDASVKDNFKARLKEIADPQDLSDALRA DIKKRAFQLATLTRHEMVAIDRFTGGGKEGAKFNVDYIECPTLTGAIYLDLHRLKQA QLKNDEDALKPALGLISLLLRDLAEGDIAFGFGANKGYGQCREHAVLDNWEERLKKI GAGLTIDGALQALRDTVALEPPAEFPPEIEKTTDDNQPEAPDFNLKPASNGFHNPYHFI PLNNPKIGDWPEAKAETLKANREGHDQYHTGKFSGRIVCSLTTQTPLFIGAETKPSTS DREPSEARPFKLNGKHAIPATSLRGMLSSLFESVSNSNFRVLHPEHYSVRKSLDDYVA LSAMGRIVDDQGELKLQPLTLPTLFGNRNNVPAKWEKIFGTPSEDDFLRIYFDDIPSKF SSNKRYFYNCKATELKDFIKSDKYFIGKRTPTVFPKSSTEKSHLESLEFIDVEKFKKAV ENLEITPGNNPYIHGWVRNLKDEFREDIPDNVKHHVFLPDTTKRVSPLEIPPHVKKRFH ELADLALAGLHLKQGETIASPYKILPYTPIGRNKLENHIHRVPNDLTCYMTRLKKGDL VFFDVDNDGQITEISFSSIWRAGIGTKNKLQTTADLLSQRDPNLVQLGMGVRTKNTDR FKLSPAERLFGVVEHRDDDNTTVENVNQPNDKAQAFAFAGKVRIGFGLPDKKTTVN GVSPVTLKELSSPKPPSPAFYLKRKNNDDFVSKKVAAECSETMTLRGRKCYLHAWRE QNGNVMKLDAIGVNSGGSTCKPPWKTHKPAANDQKEFEEDKNKFITSRQVKIAPISE NTPFYFEIDFNNLDATELAQLCATLQPAPKFEHRLGMGKPLGLGSVKIEPVGLFLINRH QRYTTDSTNCDRYHYAWLKGEHAAWDWPEYFRQNVVTADCTQTFNDTFDKLVQN GLAGTDADIKHALQLLGDPQYIGVPVHYPIAGNSTLENKHFEWFGNNDKASVLRQKA QANSKNHHYQPKQQATPEEPQYLHTITKDSKQISLLKKNKIEDIENRDQQKHRYSNHR R |
| SEQ ID NO: 632 MVRP01000104.1 | MFPKGRQMRRQRLLGDAEYYGGTGREQPASIVISTDSDPDHKVYEWIITGQLKAETG FFFGTKAGAGGHTDLSILLGKDGHYRVPRSVFRGALRRDLRVAFGAGCRVEVGRERP CECPVCKVMRQITVMDTISSYREAPEIRQRIRLNPYTGTVDKGALFDMEVGPEGIEFPF VLRFRGSKSFPSELAAVIGSWTKGTAWLGGAAATGKGRFSLLGLSIHKWNLSTAEGR KSYLAAYGLRDAADKTVKRLSIDKGGKGDVGLPAGLERDALPSSVREPLWKKLVCT VDFSSPLLLADPIAALLGVEGDERIGFDNIAYEKRRYNGETNTTESIPAVKGETFRGIVR TALGKRHGNLTRDHEDCRCRLCAVFGKEQEAGKIRFEDLMPVGAWTRKHLDHVAID RFHGGAEENMKFDTYALAASPTNPLRMKGLIWVRSDLFETGHDGPTPPYVKDIIDAL ADVKRGLYPVGGKTGSGYGWIKDVTIDGLPQGLSLPPAEERVDGVNEVPPYNYSAPP DLPSAAEGEYFFPHVFIKPYDKVDRVSRLTGHDRFRQGRITGRITCTLKTLTPLIIPDSE GIQTDATGHKMCKFFSVAGKPMIPGSEIRGMISSVYEALTNSCFRVFDEEKYLTRRVQ PKKGAKSSELVPGIIVWGQNGGLAVQQVKNAYRVPLYDDPAVTSAIPTEAQKNKER WESVPSVNLQGALDWNLTTANIARDNRTFLNSRPEEKDAILSGTKPISFELEGTNPND MLVRLVPDGVDGAHSGYLKFTGLNMVLKANKKTSRKLAPSEEDVRTLAILHNDFDS RRDWRRPPNSQRYFPRSVLRFSLERSTYTIPKRCERVFEGTCGEPYSVPSDVERQYNSII DDISKNYGRISETYLTKTANRKLTVGDLVYFIADLDKNMATHILPVFISRISDEKPLGE LLPFSGKLIPCEGEPPTILKKMAPSLLTEAWRTLISTHLEGFCPACRLFGTTSYKGRIRF GFAEHTGTPKWLREELDWARPFLTLPIQERPRPTWSVPDDKSEVPGRKFYLHHHGGN RIVESNLRNRPEVNQTKNNSSVEPISAGNTFTFDVCFENLEAWELGLLLYCLELSPKLA HKLGRAKAFGFGSVKIHVERIEERTTDGAYQDVTAVKKNGWITTGHDKLREWFHRD DWEDVDHIRNLRTVLRFPDADQEHDVRYPELKANNGVSGYVELRDKMTASERQESL RTPWYRWFPQNGTGGSGRHEQAATSQEQDTAKDESVLSATQRRQAVIDVSDPDERL SGTVESFDRQKGDGYIGCGVRQFYVRLEDIRSRTALCEGQVVTFRARKEWEGHEAYD VEIDQ |

Guide Molecules

The system may comprise a guide molecule. The guide molecule may comprise a guide sequence. In certain cases, the guide sequence may be linked to a direct repeat sequence. In some cases, the system may comprise a nucleotide sequence encoding the guide molecule. The guide molecule may form a complex with the dead Cas7-11 protein and directs the complex to bind the target RNA sequence at one or more codons encoding an amino acid that is post-translationally modified. The guide sequence may be capable of hybridizing with a target RNA sequence comprising an Adenine or Cytidine encoding said amino acid to form an RNA duplex, wherein said guide sequence comprises a non-pairing nucleotide at a position corresponding to said Adenine or Cytidine resulting in a mismatch in the RNA duplex formed. The guide sequence may comprise one or more mismatch corresponding to different adenosine sites in the target sequence. In certain cases, guide sequence may comprise multiple mismatches corresponding to different adenosine sites in the target sequence. In cases where two guide molecules are used, the guide sequence of each of the guide molecules may comprise a mismatch corresponding to a different adenosine sites in the target sequence.

In general, a CRISPR system is characterized by elements that promote the formation of a CRISPR complex at the site of a target sequence. In the context of formation of a CRISPR complex, "target sequence" refers to a sequence to which a guide sequence is designed to have complementarity, where hybridization between a target DNA sequence and a guide sequence promotes the formation of a CRISPR complex.

In certain embodiments, the target sequence should be associated with a PAM (protospacer adjacent motif) or PFS (protospacer flanking sequence or site); that is, a short sequence recognized by the CRISPR complex. Depending on the nature of the CRISPR-Cas protein, the target sequence should be selected such that its complementary sequence in the DNA duplex (also referred to herein as the non-target sequence) is upstream or downstream of the PAM. The precise sequence and length requirements for the PAM differ depending on the Cas7-11 protein used, but PAMs are typically 2-8 base pair sequences adjacent the protospacer (that is, the target sequence). Examples of the natural PAM sequences for different Cas7-11 orthologues are provided herein below and the skilled person will be able to identify further PAM sequences for use with a given Cas7-11 protein. In certain embodiments, the Cas7-11 protein has been modified to recognize a non-natural PAM, such as recognizing a PAM having a sequence or comprising a sequence YCN, YCV, AYV, TYV, RYN, RCN, TGYV, NTTN, TTN, TRTN, TYTV, TYCT, TYCN, TRTN, NTTN, TACT, TYCC, TRTC, TATV, NTTV, TTV, TSTG, TVTS, TYYS, TCYS, TBYS, TCYS, TNYS, TYYS, TNTN, TSTG, TTCC, TCCC, TATC, TGTG, TCTG, TYCV, or TCTC.

The terms "guide molecule" and "guide RNA" are used interchangeably herein to refer to RNA-based molecules that are capable of forming a complex with a CRISPR-Cas protein and comprises a guide sequence having sufficient complementarity with a target nucleic acid sequence to hybridize with the target nucleic acid sequence and direct sequence-specific binding of the complex to the target nucleic acid sequence. The guide molecule or guide RNA specifically encompasses RNA-based molecules having one or more chemically modifications (e.g., by chemical linking two ribonucleotides or by replacement of one or more ribonucleotides with one or more deoxyribonucleotides), as described herein.

As used herein, the term "guide sequence" in the context of a CRISPR-Cas system, comprises any polynucleotide sequence having sufficient complementarity with a target nucleic acid sequence to hybridize with the target nucleic acid sequence and direct sequence-specific binding of a nucleic acid-targeting complex to the target nucleic acid sequence. In the context of the present invention the target nucleic acid sequence or target sequence is the sequence comprising the target adenosine to be deaminated also referred to herein as the "target adenosine". In some embodiments, except for the intended dA-C mismatch, the degree of complementarity, when optimally aligned using a suitable alignment algorithm, is about or more than about 50%, 60%, 75%, 80%, 85%, 90%, 95%, 97.5%, 99%, or more. Optimal alignment may be determined with the use of any suitable algorithm for aligning sequences, non-limiting example of which include the Smith-Waterman algorithm, the Needleman-Wunsch algorithm, algorithms based on the Burrows-Wheeler Transform (e.g., the Burrows Wheeler Aligner), ClustalW, Clustal X, BLAT, Novoalign (Novocraft Technologies; available at www.novocraft.com), ELAND (Illumina, San Diego, CA), SOAP (available at soap.genomics.org.cn), and Maq (available at maq.sourceforge.net). The ability of a guide sequence (within a nucleic acid-targeting guide RNA) to direct sequence-specific binding of a nucleic acid-targeting complex to a target nucleic acid sequence may be assessed by any suitable assay. For example, the components of a nucleic acid-targeting CRISPR system sufficient to form a nucleic acid-targeting complex, including the guide sequence to be tested, may be provided to a host cell having the corresponding target nucleic acid sequence, such as by transfection with vectors encoding the components of the nucleic acid-targeting complex, followed by an assessment of preferential targeting (e.g., cleavage) within the target nucleic acid sequence, such as by Surveyor assay as described herein. Similarly, cleavage of a target nucleic acid sequence (or a sequence in the vicinity thereof) may be evaluated in a test tube by providing the target nucleic acid sequence, components of a nucleic acid-targeting complex, including the guide sequence to be tested and a control guide sequence different from the test guide sequence, and comparing binding or rate of cleavage at or in the vicinity of the target sequence between the test and control guide sequence reactions. Other assays are possible, and will occur to those skilled in the art. A guide sequence, and hence a nucleic acid-targeting guide RNA may be selected to target any target nucleic acid sequence.

In some embodiments, the guide molecule comprises a guide sequence that is designed to have at least one mismatch with the target sequence, such that an RNA duplex formed between the guide sequence and the target sequence comprises a non-pairing C in the guide sequence opposite to the target A for deamination on the target sequence. In some embodiments, aside from this A-C mismatch, the degree of complementarity, when optimally aligned using a suitable alignment algorithm, is about or more than about 50%, 60%, 75%, 80%, 85%, 90%, 95%, 97.5%, 99%, or more. In some cases, the distance between the non-pairing C and the 5' end of the guide sequence is from about 10 to about 50, e.g., from about 10 to about 20, from about 15 to about 25, from about 20 to about 30, from about 25 to about 35, from about 30 to about 40, from about 35 to about 45, or from about 40 to about 50 nucleotides (nt) in length. In certain example. In some cases, the distance between the non-pairing C and the 3' end of the guide sequence is from about 10 to about 50, e.g., from about 10 to about 20, from about 15 to about 25, from about 20 to about 30, from about 25 to about 35, from about 30 to about 40, from about 35 to about 45, or from about 40 to about 50 nucleotides (nt) in length. In one example, the distance between the non-pairing C and the 5' end of said guide sequence is from about 20 to about 30 nucleotides.

In certain embodiments, the guide sequence or spacer length of the guide molecules is from 15 to 50 nt. In certain embodiments, the spacer length of the guide RNA is at least 15 nucleotides. In certain embodiments, the spacer length is from 15 to 17 nt, e.g., 15, 16, or 17 nt, from 17 to 20 nt, e.g., 17, 18, 19, or 20 nt, from 20 to 24 nt, e.g., 20, 21, 22, 23, or 24 nt, from 23 to 25 nt, e.g., 23, 24, or 25 nt, from 24 to 27 nt, e.g., 24, 25, 26, or 27 nt, from 27-30 nt, e.g., 27, 28, 29, or 30 nt, from 30-35 nt, e.g., 30, 31, 32, 33, 34, or 35 nt, or 35 nt or longer. In certain example embodiment, the guide sequence is 15, 16, 17, 18, 19, 20, 21, 22, 23, 24, 25, 26, 27, 28, 29, 30, 31, 32, 33, 34, 35, 36, 37, 38, 39 40, 41, 42, 43, 44, 45, 46, 47 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, or 100 nt.

In some embodiments, the guide sequence has a length from about 10 to about 100, e.g., from about 20 to about 60, from about 20 to about 55, from about 20 to about 53, from about 25 to about 53, from about 29 to about 53, from about 20 to about 30, from about 25 to about 35, from about 30 to about 40, from about 35 to about 45, from about 40 to about 50, from about 45 to about 55, from about 50 to about 60, from about 55 to about 65, from about 60 to about 70, from about 70 to about 80, from about 80 to about 90, or from about 90 to about 100 nucleotides (nt) long that is capable of forming an RNA duplex with a target sequence. In certain example, the guide sequence has a length from about 20 to about 53 nt capable of forming said RNA duplex with said target sequence. In certain example, the guide sequence has a length from about 25 to about 53 nt capable of forming said RNA duplex with said target sequence. In certain example, the guide sequence has a length from about 29 to about 53 nt capable of forming said RNA duplex with said target sequence. In certain example, the guide sequence has a length from about 40 to about 50 nt capable of forming said RNA duplex with said target sequence. In some examples, the guide sequence comprises a non-pairing Cytosine at a position corresponding to said Adenine resulting in an A-C mismatch in the RNA duplex formed. The guide sequence is selected so as to ensure that it hybridizes to the target sequence comprising the adenosine to be deaminated.

In some embodiments, the guide sequence is about 10 nt to about 100 nt long and hybridizes to the target DNA strand to form an almost perfectly matched duplex, except for having a dA-C mismatch at the target adenosine site. Particularly, in some embodiments, the dA-C mismatch is located close to the center of the target sequence (and thus the center of the duplex upon hybridization of the guide sequence to the target sequence), thereby restricting the nucleotide deaminase to a narrow editing window (e.g., about 4 bp wide). In some embodiments, the target sequence may comprise more than one target adenosine to be deaminated. In further embodiments, the target sequence may further comprise one or more dA-C mismatch 3' to the target adenosine site. In some embodiments, to avoid off-target editing at an unintended Adenine site in the target sequence, the guide sequence can be designed to comprise a non-pairing Guanine at a position corresponding to said unintended Adenine to introduce a dA-G mismatch, which is catalytically unfavorable for certain nucleotide deaminases such as ADAR1 and ADAR2. See Wong et al., RNA 7:846-858 (2001), which is incorporated herein by reference in its entirety.

In some embodiments, the sequence of the guide molecule (direct repeat and/or spacer) is selected to reduce the degree secondary structure within the guide molecule. In some embodiments, about or less than about 75%, 50%, 40%, 30%, 25%, 20%, 15%, 10%, 5%), 1%), or fewer of the nucleotides of the nucleic acid-targeting guide RNA participate in self-complementary base pairing when optimally folded. Optimal folding may be determined by any suitable polynucleotide folding algorithm. Some programs are based on calculating the minimal Gibbs free energy. An example of one such algorithm is mFold, as described by Zuker and Stiegler (Nucleic Acids Res. 9 (1981), 133-148). Another example folding algorithm is the online webserver RNAfold, developed at Institute for Theoretical Chemistry at the University of Vienna, using the centroid structure prediction algorithm (see e.g., A. R. Gruber et al., 2008, Cell 106(1): 23-24; and PA Carr and GM Church, 2009, Nature Biotechnology 27(12): 1151-62).

In some embodiments, it is of interest to reduce the susceptibility of the guide molecule to RNA cleavage, such as to cleavage by Cas7-11. Accordingly, in particular embodiments, the guide molecule is adjusted to avoid cleavage by Cas7-11 or other RNA-cleaving enzymes.

In some embodiments, the guide molecule is modified, e.g., by one or more aptamer(s) designed to improve guide molecule delivery, including delivery across the cellular membrane, to intracellular compartments, or into the nucleus. Such a structure can include, either in addition to the one or more aptamer(s) or without such one or more aptamer(s), moiety(ies) so as to render the guide molecule deliverable, inducible or responsive to a selected effector. The invention accordingly comprehends a guide molecule that responds to normal or pathological physiological conditions, including without limitation pH, hypoxia, $O_2$ concentration, temperature, protein concentration, enzymatic concentration, lipid structure, light exposure, mechanical disruption (e.g. ultrasound waves), magnetic fields, electric fields, or electromagnetic radiation.

Adenosine Deaminase

The system may further comprise an adenosine deaminase or catalytic domain thereof. The adenosine deaminase protein or catalytic domain thereof deaminates an Adenine or Cytidine at the one or more codons thereby changing the codon to encode for an amino acid that is not post-translationally modified. The term "adenosine deaminase" or "adenosine deaminase protein" as used herein refers to a protein, a polypeptide, or one or more functional domain(s) of a protein or a polypeptide that is capable of catalyzing a hydrolytic deamination reaction that converts an adenine (or an adenine moiety of a molecule) to a hypoxanthine (or a hypoxanthine moiety of a molecule), as shown below. In some embodiments, the adenine-containing molecule is an adenosine (A), and the hypoxanthine-containing molecule is an inosine (I). The adenine-containing molecule can be deoxyribonucleic acid (DNA) or ribonucleic acid (RNA).

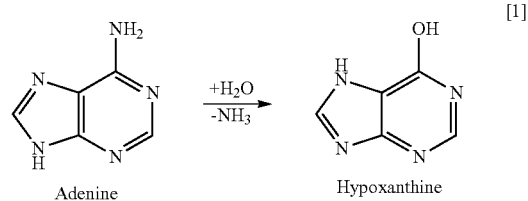

According to the present disclosure, adenosine deaminases that can be used in connection with the present disclosure include, but are not limited to, members of the enzyme family known as adenosine deaminases that act on RNA (ADARs), members of the enzyme family known as adenosine deaminases that act on tRNA (ADATs), and other adenosine deaminase domain-containing (AD AD) family members. According to the present disclosure, the adenosine deaminase is capable of targeting adenine in a RNA/DNA and RNA duplexes. Indeed, Zheng et al. (Nucleic Acids Res. 2017, 45(6): 3369-3377) demonstrate that ADARs can carry out adenosine to inosine editing reactions on RNA/DNA and RNA/RNA duplexes. The adenosine deaminase can be modified to increase its ability to edit DNA in a RNA/DNAn RNA duplex.

In some embodiments, the adenosine deaminase is derived from one or more metazoa species, including but not limited to, mammals, birds, frogs, squids, fish, flies and worms. In some embodiments, the adenosine deaminase is a human, cephalopod (e.g., squid) or Drosophila adenosine deaminase. In certain examples, the adenosine deaminase is a human adenosine deaminase. In certain examples, the adenosine deaminase is a cephalopod adenosine deaminase. In certain examples, the adenosine deaminase is a *Drosophila* adenosine deaminase.

Cytidine Deaminase

The term "cytidine deaminase" or "cytidine deaminase protein" as used herein refers to a protein, a polypeptide, or one or more functional domain(s) of a protein or a polypeptide that is capable of catalyzing a hydrolytic deamination reaction that converts a cytosine (or a cytosine moiety of a molecule) to an uracil (or an uracil moiety of a molecule), as shown below. In some embodiments, the cytosine-containing molecule is a cytidine (C), and the uracil-containing molecule is an uridine (U). The cytosine-containing molecule can be deoxyribonucleic acid (DNA) or ribonucleic acid (RNA).

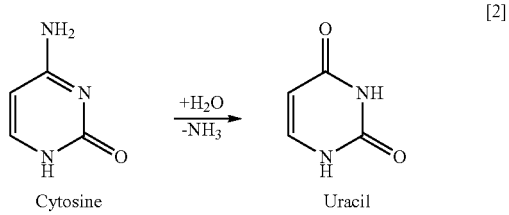

[2]

Cytosine  Uracil

According to the present disclosure, cytidine deaminases that can be used in connection with the present disclosure include, but are not limited to, members of the enzyme family known as apolipoprotein B mRNA-editing complex (APOBEC) family deaminase, an activation-induced deaminase (AID), or a cytidine deaminase 1 (CDA1). In particular embodiments, the deaminase in an APOBEC 1 deaminase, an APOBEC2 deaminase, an APOBEC3A deaminase, an APOBEC3B deaminase, an APOBEC3C deaminase, and APOBEC3D deaminase, an APOBEC3E deaminase, an APOBEC3F deaminase an APOBEC3G deaminase, an APOBEC3H deaminase, or an APOBEC4 deaminase. The cytidine deaminase can be modified to increase its ability to edit DNA in a RNA/DNAn RNA duplex.

In some embodiments, the cytidine deaminase is derived from one or more metazoa species, including but not limited to, mammals, birds, frogs, squids, fish, flies and worms. In some embodiments, the cytidine deaminase is a human, primate, cow, dog, rat or mouse cytidine deaminase.

CD (cytidine deaminase)-functionalized CRISPR system for RNA editing can be used for C to U conversions. In some embodiments, the cytidine deaminase protein or catalytic domain thereof is a human, rat or lamprey cytidine deaminase protein or catalytic domain thereof. In some embodiments, the cytidine deaminase protein or catalytic domain thereof is an apolipoprotein B mRNA-editing complex (APOBEC) family deaminase, an activation-induced deaminase (AID), or a cytidine deaminase 1 (CDA1). In some embodiments, the cytidine deaminase protein or catalytic domain thereof is an APOBEC1 deaminase comprising one or more mutations corresponding to W90A, W90Y, R118A, H121R, H122R, R126A, R126E, or R132E in rat APOBEC1, or an APOBEC3G deaminase comprising one or more mutations corresponding to W285A, W285Y, R313A, D316R, D317R, R320A, R320E, or R326E in human APOBEC3G. In some embodiments, the cytidine deaminase protein or catalytic domain thereof is delivered together with an uracil glycosylase inhibitor (UGI), where said UGI is covalently linked to said cytidine deaminase protein or catalytic domain thereof and/or said catalytically inactive Cas7-11 protein.

Cas7-11-APOBEC fusions can perform C-to-U editing of RNA. APOBEC substrates are ssRNA and the Cas7-11-APOBEC can therefore target regions of the RNA around the guide/target duplex. Cas7-11-APOBEC fusions can perform C to U knockdown via stop codon introduction. In addition to correcting pathogenic U to C mutations that arise during the cellular life cycle, Cas7-11-APOBEC fusions can lead to the introduction of stop codons by converting a CAA, CGA, or CAG to TAA, TGA, or TAG, respectively. APOBEC orthologs in fusion with Cas7-11 can increase the efficiency of C-to-U editing, or can allow for additional types of base conversions. Mutating the APOBEC from the Cas7-11-APOBEC can lead to fusions with specific dsRNA activity, base flip activity and increased activity.

In certain example embodiments, the deaminase is selected from Table 2.

TABLE 2

| SEQ ID NO & Deaminase Name | Protein Sequence |
|---|---|
| SEQ ID NO: 33<br>Homo sapiens_ADAR2_E_Q_ Mutant | QLHLPQVLADAVSRLVLGKFGDLTDNFSSPHARRKVLAGVVMTTGTDVKDAKV<br>ISVSTGTKCINGEYMSDRGLALNDCHAEIISRRSLLRFLYTQLELYLNNKDDQKRS<br>IFQKSERGGFRLKENVQFHLYISTSPCGDARIFSPHEPILEEPADRHPNRKARGQLR<br>TKIESGQGTIPVRSNASIQTWDGVLQGERLLTMSCSDKIARWNVVGIQGSLLSIFV<br>EPIYFSSIILGSLYHGDHLSRAMYQRISNIEDLPPLYTLNKPLLSGISNAEARQPGKA<br>PNFSVNWTVGDSAIEVINATTGKDELGRASRLCKHALYCRWMRVHGKVPSHLL<br>RSKITKPNVYHESKLAAKEYQAAKARLFTAFIKAGLGAWVEKPTEQDQFSLT* |
| SEQ ID NO: 34<br>Homo sapiens_ADAR1_E_Q_ Mutant | SLGTGNRCVKGDSLSLKGETVNDCHAEIISRRGFIRFLYSELMKYNSQTAKDSIFE<br>PAKGGEKLQIKKTVSFHLYISTAPCGDGALFDKSCSDRAMESTESRHYPVFENPK<br>QGKLRTKVENGQGTIPVESSDIVPTWDGIRLGERLRTMSCSDKILRWNVLGLQGA<br>LLTHFLQPIYLKSVTLGYLFSQGHLTRAICCRVTRDGSAFEDGLRHPFIVNHPKVG<br>RVSIYDSKRQSGKTKETSVNWCLADGYDLEILDGTRGTVDGPRNELSRVSKKNIF<br>LLFKKLCSFRYRRDLLRLSYGEAKKAARDYETAKNYFKKGLKDMGYGNWISKP<br>QEEKNF |
| SEQ ID NO: 35<br>Octopus vulgaris_ADAR1_E_Q_ Mutant | SVGTGNRCLTGDHLSLEGNSVNDSHAEMITRRGFLRYLYRHLLEYDAEVPNDLF<br>EKGERSICRIKTNITFHLYISTAPCGDGALFSPRDTDSSNAKMEEENKHIHNPTFSS<br>SVQGLLRTKVEGGQGTIPIDADFTEQTWDGIQRGERLRTMSCSDKICRWNVVGL<br>QGALLSHFIEPIYLDSLTLGYLYDHGHLARAVCCRIERGEASVNQLLPEGYRLNH<br>PWLGRVTACDPPRETQKTKSLSINWCYDDEKSEVLDGTAGICYTAIEKNLFSRLT<br>KHNLYEEFKRVCRKFDRNDLLTAPSYNKAKMMATPFQTAKNVMLKKLKENNC<br>GTWVSKPIEEEMF |

TABLE 2-continued

| SEQ ID NO & Deaminase Name | Protein Sequence |
|---|---|
| SEQ ID NO: 36 Sepia_ADAR1_E_Q_ Mutant | SVGTGNRCLTGDRLSLEGNSVNDSHAEMVTRRGFLRYLYKHLLEYDPEKPHDLF EKGERSLCRIKTNITFHLYISTAPCGDGALFSPRDTDSSNVKVDEENKHVHNPTFS SSVQGLLRTKVEGGQGTIPIDADFTEQTWDGIQRGERLRTMSCSDKICRWNVVGL QGALLSHFVEPIYLESLTLGLYLDDHGHLARAVCCRIERGEASVNQLLPEGYRLNH PWLGRVTACDPPRETQKTKSLSINWCYDDEKSEVLDGTAGICYTAIEKNLFSRLT KHSLYEEFKKVCQKFEREDLLNVTSYNKAKMMAIPFQTAKNVMLKKLKENNCG TWVSKPIEEEMF |
| SEQ ID NO: 37 Octopus vulgaris_ADAR2_E_Q_ Mutant | GIGTGTKCINGEHMSDRGFGVNDCHAEIIARRCFLRYIYDQLELHLSDNSDVRNSS IFELRDKGGYQLKENIQFHLYISTAPCGDARIFSPHGQDVETGDRHPNRKARGQL RTKIESGQGTIPVRTSGVIQTWDGVLEGERLLTMSCSDKIARWNVLGIQGSLLSHF MNPIYLESIILGSLYHSDHLSRAMYSRISIIENLPEPFHLNRPFLSGISSPESRQPGKA PNFGINWRKEDETFEVINAMTGRVEGGSVSRICKQALFGRFMSLYGKLSSLTGQS VTTRPTHYSDAKAAVMEYQLAKQCVFQAFQKAGLGNWVQKPIEQDQF |
| SEQ ID NO: 38 Sepia_ADAR2_E_Q_ Mutant | GIGTGTKCINGEYMNDRGFAVNDCHAEIIARRCFLRFIYDQLEMHLSEDPEVRGQ SVFELRDGGGYKLKPNIHFHLYISTAPCGDARIFSPHGQDVETGDRHPNRKARGQ LRTKIESGQGTIPVRSSGFIQTWDGVLEGERLLTMSCSDKIARWNVLGIQGALLCH FMHPIYLESIILGSLYHSDHLSRAVYCRIASIENLPDLFQLNRPFLSGISSPESRQPG KAPNFGINWRRNDDTFEVINAMTGRVEGGNMSRICKQALFDRFMNLYGRLSSLT GQSVTTRPTLYSEAKAAVMEYQLAKQCVFQAFQKAGLGNWVQKPIEQDQF |
| SEQ ID NO: 39 Doryteusthis opalescens_ADAR2_E_ Q_Mutant | GIGTGTKCINGEYMNDRGFAVNDCHAEIIARRCFLRFIYDQLELHLSDNAEVRGQ SIFELRDAGGYKLKPNIQFHLYISTAPCGDARIFSPHGQDVETGDRHPNRKARGQL RTKIESGQGTIPVRSSGFIQTWDGVLEGERLLTMSCSDKIARWNVLGIQGALLCH FMHPIYLESIILGSLYHSDHLSRAVYCRIAAIENLPDLFRLNRPFLSGISSPESRQPG KAPNFGINWRRNDDSFEVINAMTGRVEGGSMSRICKQALFDRFMNLYGKLSSLT GQSVTTRPALYSEAKATVMEYQLAKQCVFQAFQKAGLGNWVQKPIEQDQF |
| SEQ ID NO: 40 APOBEC1 | MTSEKGPSTGDPTLRRRIEPWEFDVFYDPRELRKEACLLYEIKWGMSRKIWRSSG KNTTNHVEVNFIKKFTSERDFHPSMSCSITWFLSWSPCWECSQAIREFLSRHPGVT LVIYVARLFWHMDQQNRQGLRDLVNSGVTIQIMRASEYYHCWRNFVNYPPGDE AHWPQYPPLWMMLYALELHCIILSLPPCLKISRRWQNHLTFFRLHLQNCHYQTIP PHILLATGLIHPSVAWR |
| SEQ ID NO: 41 APOBEC2 | MAQKEEAAVATEAASQNGEDLENLDDPEKLKELIELPPFEIVTGERLPANFFKFQ FRNVEYSSGRNKTFLCYVVEAQGKGGVQASRGYLEDEHAAAHAEEAFFNTILP AFDPALRYNVTWYVSSSPCAACADRIIKTLSKTKNLRLLILVGRLFMWEEPEIQA ALKKLKEAGCKLRIMKPQDFEYVWQNFVEQEEGESKAFQPWEDIQENFLYYEEK LADILK |
| SEQ ID NO: 42 APOBEC3A | MEASPASGPRHLMDPHIFTSNFNNGIGRHKTYLCYEVERLDNGTSVKMDQHRGF LHNQAKNLLCGFYGRHAELRFLDLVPSLQLDPAQIYRVTWFISWSPCFSWGCAG EVRAFLQENTHVRLRIFAARIYDYDPLYKEALQMLRDAGAQVSIMTYDEFKHCW DTFVDHQGCPFQPWDGLDEHSQALSGRLRAILQNGQN |
| SEQ ID NO: 43 APOBEC3B | MNPQIRNPMERMYRDTFYDNFENEPILYGRSYTWLCYEVKIKRGRSNLLWDTGV FRGQVYFEPQYHAEMCFLSWFCGNQLPAYKCFQITWFVSWTPCPDCVAKLAEFL SEHPNVTLTISAARLYYYWERDYRRALCRLSQAGARVKIMDYEEFAYCWENFV YNEGQQFMPWYKFDENYAFLHRTLKEILRLRIFSVAPTAAMRSCASWTWFLLCS WTRPRSTGSLGSSPGAPASPGAVPGKCVRSFRRTHT |
| SEQ ID NO: 44 APOBEC3C | MNPQIRNPMKAMYPGTFYFQFKNLWEANDRNETWLCFTVEGIKRRSVVSWKTG VFRNQVDSETHCHAERCFLSWFCDDILSPNTKYQVTWYTSWSPCPDCAGEVAEF LARHSNVNLTIFTARLYYFQYPCYQEGLRSLSQEGVAVEIMDYEDFKYCWENFV YNDNEPFKPWKGLKTNFRLLKRRLRESLQ |
| SEQ ID NO: 45 APOBEC3D | MNPQIRNPMERMYRDTFYDNFENEPILYGRSYTWLCYEVKIKRGRSNLLWDTGV FRGPVLPKRQSNHRQEVYFRFENHAEMCFLSWFCGNRLPANRRFQITWFVSWNP CLPCVVKVTKFLAEHPNVTLTISAARLYYYRDRDWRWVLLRLHKAGARVKIMD YEGERCRGQGSMTGRNSLRDGWICNAMAGGVPGQPAGVGLALIATDSQETRPG RAGPSGSESLSASHLFISDFAYCWENFVCNEGQPFMPWYKFDDNYASLHRTLKEI LRNPMEAMYPHIFYFHFKNLLKACGRNESWLCFTMEVTKHHSAVFRKRGVFRN QVDPETHCHAERCFLSWFCDDILSPNTNYEVTWYTSWSPCPECAGEVAEFLARH SNVNLTIFTARLCYFWDTDYQEGLCSLSQEGASVKIMGYKDFVSCWKNFVYSDD EPFKPWKGLQTNFRLLKRRLREILQ |
| SEQ ID NO: 46 APOBEC3F | MKPHFRNTVERMYRDTFSYNFYNRPILSRRNTVWLCYEVKTKGPSRPRLDAKIF RGQVYSQPEHHAEMCFLSWFCGNQLPAYKCFQITWFVSWTPCPDCVAKLAEFL AEHPNVTLTISAARLYYYWERDYRRALCRLSQAGARVKIMDDEEFAYCWENFV YSEGQPFMPWYKFDDNYAFLHRTLKEILRNPMEAMYPHIFYPHFKNLRKAYGRN ESWLCFTMEVVKHHSPVSWKRGVFRNQVDPETHCHAERCFLSWFCDDILSPNTN YEVTWYTSWSPCPECAGEVAEFLARHSNVNLTIFTARLYYFWDTDYQEGLRSLS QEGASVEIMGYKDFKYCWENFVYNDDEPFKPWKGLKYNFLFLDSKLQEILE |

TABLE 2-continued

| SEQ ID NO & Deaminase Name | Protein Sequence |
|---|---|
| SEQ ID NO: 47 APOBEC3G | MELKYHPEMRFFHWFSKWRKLHRDQEYEVTWYISWSPCTKCTRDMATFLAEDP KVTLTIFVARLYYFWDPDYQEALRSLCQKRDGPRATMKIMNYDEFQHCWSKFV YSQRELFEPWNNLPKYYILLHIMLGEILRHSMDPPTFTFNFNNEPWVRGRHETYL CYEVERMHNDTWVLLNQRRGFLCNQAPHKHGFLEGRHAELCFLDVIPFWKLDL DQDYRVTCFTSWSPCFSCAQEMAKFISKNKHVSLCIFTARIYDDQGRCQEGLRTL AEAGAKISIMTYSEFKHCWDTFVDHQGCPFQPWDGLDEHSQDLSGRLRAILQNQ EN |
| SEQ ID NO: 48 APOBEC3H | MALLTAETFRLQFNNKRRLRRPYYPRKALLCYQLTPQNGSTPTRGYFENKKKCH AEICFINEIKSMGLDETQCYQVTCYLTWSPCSSCAWELVDFIKAHDHLNLRIFASR LYYHWCKPQQDGLRLLCGSQVPVEVMGFPDSRGTCAGSLHGYIV |
| SEQ ID NO: 49 APOBEC4 | MEPIYEEYLANHGTIVKPYYWLSFSLDCSNCPYHIRTGEEARVSLTEFCQIFGFPY GTTFPQTKHLTFYELKTSSGSLVQKGHASSCTGNYIHPESMLFEMNGYLDSAIYN NDSIRHIILYSNNSPCNEANHCCISKMYNFLITYPGITLSIYFSQLYHTEMDFPASA WNREALRSLASLWPRVVLSPISGGIWHSVLHSFISGVSGSHVFQPILTGRALADRH NAYEINAITGVKPYFTDVLLQTKRNPNTKAQEALESYPLNNAFPGQFFQMPSGQL QPNLPPDLRAPVVFVLVPLRDLPPMHMGQNPNKPRNIVRHLNMPQMSFQETKDL GRLPTGRSVEIVEITEQFASSKEADEKKKKKGKK |
| SEQ ID NO: 50 Activation-induced cytidine deaminase (AID) | MDSLLMNRKFLYQFKNVRWAKGRRETYLCYVVERRDSATSFSLDFGYLRNKNG CHVELLFLRYISDWDLDPGRCYRVTWFTSWSPCYDCARHVADFLRGNPNLSLRI FTARLYFCEDRKAEPEGLRRLHRAGVQIAIMTFKDYFYCWNTFVENHERTFKAW BGLHENSVRLSRQLRRILL |

EXAMPLES

While several experimental Examples are contemplated, these Examples are intended non-limiting.

Materials

Table 3 below shows examples of bacterial plasmids.

TABLE 3

| Plasmid number | Name | Benchling link |
|---|---|---|
| pDF0038 | DsiCas7-11a full locus with CRISPR array | https://benchling.com/s/seq-72T3bYt8Ff9QNtG7aE2X |
| pDF0039 | DsiCas7-11a only expression with CRISPR array | https://benchling.com/s/seq-uiS8cQyZLi2NrqfhxWF2 |
| pDF0044 | CjcCas7-11b full locus with synthetic array | https://benchling.com/s/seq-GXIXQfFqwbN2vu7g6NUV |
| pDF0118 | DsiCas7-11a bacterial expression with Twinstrep-SUMO-Codon | https://benchling.com/s/seq-PSpbXxlK66yLBw0TbxnY |
| pDF0163 | GwCas7-11c bacterial expression with Twinstrep-SUMO-Codon | https://benchling.com/s/seq-CsMaJRrLeJ15XtHvMFd1 |
| pDF0191 | CjcCas7-11b bacterial expression with Twinstrep-SUMO-Codon | https://benchling.com/s/seq-lLOOF2Yl8T6v2jUuQ9Q3 |
| pDF0229 | DsiCas7-11a expression vcetor with golden gate site for guides | https://benchling.com/s/seq-mPWeEpoNVZVKxJwlIhVj |

Table 4 below shows examples of bacterial spacers.

TABLE 4

| SEQ ID NO | Spacer sequence | Target |
|---|---|---|
| SEQ ID NO: 51 | CTTTGTTGTCTTCGACATGGGTAATCCTCAT | MS2 targeting 1 |
| SEQ ID NO: 52 | TAAAGAGTTGAACTTCTTTGTTGTCTTCGAC | MS2 targeting 3 |
| SEQ ID NO: 53 | GTACCTTCGTACGGACGACCTTCACCTTCAC | RFP targeting 1 |
| SEQ ID NO: 54 | CAGGATGTCCCAAGCGAACGGCAGCGGACCA | RFP targeting 2 |
| SEQ ID NO: 55 | CAGGGAGGAGTCCTGGGTAACGGTAACAACA | RFP targeting 3 |

TABLE 4-continued

| SEQ ID NO | Spacer sequence | Target |
|---|---|---|
| SEQ ID NO: 56 | CATGAACTCTTTGATAACGTCTTCGCTACTC | RFP targeting 4 |
| SEQ ID NO: 57 | TCGGAGGTAGCCCGACTCGCTCCGGTTCGTA | non-targeting 1 |
| SEQ ID NO: 58 | TGAAAGTTGGCGCCTTTTTTCATACGTCGAG | non-targeting 2 |

Table 5 below shows examples of targets and pre-crRNA.

TABLE 5

| Target | Sequence |
|---|---|
| SEQ ID NO: 59<br>DsiCas7-11 array<br>(4DR-3S) | GGGCGAAAUCGGUAUUUCCAAUGAAAUCACUCAGGUUGGAAAGCCGGUUUUC<br>UUUGAUGUCACGGAACCGCCAAUAUAACAAUACAGGUAUUAUAGUUGGGUUG<br>GAAAGCCGGUUUUCUUUGAUGUCACGGAACAUUGUAAACUGCAUAUCUGUGU<br>UUGCCGUCUGGUUGGAAAGCCGGUUUUCUUUGAUGUCACGGAACUCACGUGA<br>GUCAGUCUUAGUUCUAUACUUCUUUAGGGUUGGAAAGCCGGUUUUCUUUGAU<br>GUCACGGAACAGGAACUUGAACAACAUCGUUACUAACGAG |
| SEQ ID NO: 60<br>ssRNA 1 target | GGGGGCCAGUGAAUUCGAGCUCGGUACCCGGGGAUCCUCUAGAAAUAUGGAU<br>UACUUGGUAGAACAGCAAUCUACUCGACCUGCAGGCAUGCAAGCUUGGCGUA<br>AUCAUGGUCAUAGCUGUUUCCUGUGUUUAUCCGCUCACAAUUCCACACAACA<br>UACGAGCCGGAAGCAUAAAG |
| SEQ ID NO: 61<br>MS2 target for<br>body labeling | GGGGCAAACUCCGGCAUCUACUAAUAGACGCCGGCCAUUCAAACAUGAGGAU<br>UACCCAUGUCGAAGACAACAAAGAAGUUCAACUCUUUAUGUAUUGAUCUUCC<br>UCGCGAUCUUUCUCUCGAAAUUUACCAAUCAAUUGCUUCUGCUGCUACU |
| SEQ ID NO: 62<br>SSRNA 2 target | GGGGGCCAGUGAAUUCGAGCUCGGUACCCGGGGAUCCUCUAGAAAUAUGGAU<br>UACUUGGUAGAACAGCAAUCUACUCGACCUGCAGGCAUGCAAGCUUGGCGUA<br>AUCAUGGUCAUAGCUGUUUCCUGUGUUUAUCCGCUCACAAUUCCACACA |
| SEQ ID NO: 63<br>fixed crRNA<br>target 1 | GGCCAGUGAAUUCGAGCUCGGUACCCGGGGAUCCUCUAGAAAUAUGGAUUAC<br>UUGGGUCGAAGACAACAAAGAAGUUCAACUCUUUAUGAACAGCAAUCUACU<br>CGACCUGCAGGCAUGCAAGCUUGGCGUAAUCAUGGUCAUAGCUGUU |
| SEQ ID NO: 64<br>fixed crRNA<br>target 2 | AUGCCCGCCAUGAAGAUCGAGUGCCGCAUCACCGGCACCCUGAACGGCGUGGA<br>GUUGUCGAAGACAACAAAGAAGUUCAACUCUUUACGAGCUGGUGGGCGGCGG<br>AGAGGGCACCCCCGAGCAGGGCCGCAUGACCAACAAGAUGAAGAG |
| SEQ ID NO: 65<br>fixed crRNA<br>target 3 | AUUCUAUGUCUGGUUUUCGCUCAAAAACUUCCCGGAAAUGACAACAGCACGG<br>CAACGUCGAAGACAACAAAGAAGUUCAACUCUUUAGCUGUGCCUUGGGCACC<br>AUGCAGUACCAAACGGAACGAUAGUGAAAACAAUCACGAAUGACCA |
| SEQ ID NO: 66<br>fixed crRNA<br>target 4 | AUUCUAUGUCUGGUUUUCGCUCAAAAACUUCCCGGAAAUGACAACAGCACGG<br>CAACGUCGAAGACAACAAAGAAGUUCAACUCUUUAGCUGUGCCUUGGGCACC<br>AUGCAGUACCAAACGGAACGAUAGUGAAAACAAUCACGAAUGACCA |
| SEQ ID NO: 67<br>fixed crRNA<br>target 5 | GCUGUGCCUUGGGCACCAUGCAGUACCAAACGGAACGAUAGUGAAAACAAUC<br>ACGAAUGACCAGUCGAAGACAACAAAGAAGUUCAACUCUUUAAUUCUAUGUC<br>UGGUUUUCGCUCAAAAACUUCCCGGAAAUGACAACAGCACGGCAAC |
| SEQ ID NO: 68<br>GwCas7-11<br>array (3DR-2S) | GGGGUUUGGAAGCCGGGUCGAAGUCAGGCCCGUUAAGACCGAGUAGAUUGCU<br>GUUCUACCAAGUAAUCCAGUUUGGAAGCCGGGUCGAAGUCAGGCCCGUUAAG<br>ACAUGCUUCCGGCUCGUAUGUUGUGUGGAAUUGUUUGGAAGCCGGGUCGAA<br>GUCAGGCCCGUUAAGAC |
| SEQ ID NO: 69<br>CjcCas7-11 array<br>(3DR-2S) | GGGGCUAGCUCAGUCCUAGGUAUAAUGCUAGCGCUGAUUUAGGCAAAACGG<br>CUUGAAGACUAAAGGAAGGAAUUAAUGUCACGGUACGACUAAAUGGCACCAC<br>UAAUUGUUGCCUUCUAAGUUCCUUCUUGAAGACUAAAGGAAGGAAUUAAUGU<br>CACGGUACGUUUGUUUAACCACAUGAGGCACACCGCCCUCGUGAGCUUGAAG<br>ACUAAAGGAAGGAAUUAAUGUCACGGUACAAUCUCCGCCCCGUUCGUAAGC |
| SEQ ID NO: 70<br>EGFP ssRNA<br>400 nt | AUGCCCGCCAUGAAGAUCGAGUGCCGCAUCACCGGCACCCUGAACGGCGUGGA<br>GUUCGAGCUGGUGGGCGGCGGAGAGGGCACCCCCGAGCAGGGCCGCAUGACC<br>AACAAGAUGAAGAGCACCAAAGGCGCCCUGACCUUCAGCCCCUACCUGCUGAG<br>CCACGUGAUGGGCUACGGCUUCUACCACUUCGGCACCUACCCCAGCGGCUACG<br>AGAACCCCUUCCUGCACGCCAUCAACAACGGCGGCUACACCAACACCCGCAUC<br>GAGAAGUACGAGGACGGCGGCGUGCUGCACGUGAGCUUCAGCUACCGCUACG<br>AGGCCGGCCGCGUGAUCGGCGACUUCAAGGUGGUGGGCACCGGCUUCCCCGAG<br>GACAGCGUGAUCUUCACCGACAAGAUCAUCC |
| SEQ ID NO: 71<br>MS2 crRNA 1<br>(mini array) WT | GGGGUUGGAAAGCCGGUUUUCUUUGAUGUCACGGAACCUUUGUUGUCUUCGA<br>CAUGGGUAAUCCUCAUGGUUGGAAAGCCGGUUUUCUUUGAUGUCACGGAAC |

TABLE 5-continued

| Target | Sequence |
|---|---|
| SEQ ID NO: 72<br>MS2 crRNA 1<br>(mini array)<br>mutant pos 1 | GGCGUUGGAAAGCCGGUUUUCUUUGAUGUCACGGAACCUUUGUUGUCUUCGACAUGGGUAAUCCUCAUCGUUGGAAAGCCGGUUUUCUUUGAUGUCACGGAAC |
| SEQ ID NO: 73<br>MS2 crRNA 1<br>(mini array)<br>mutant pos 3 | GGGGAUGGAAAGCCGGUUUUCUUUGAUGUCACGGAACCUUUGUUGUCUUCGACAUGGGUAAUCCUCAUGGAUGGAAAGCCGGUUUUCUUUGAUGUCACGGAAC |
| SEQ ID NO: 74<br>MS2 crRNA 1<br>(mini array)<br>mutant pos 5 | GGGGUUCGAAAGCCGGUUUUCUUUGAUGUCACGGAACCUUUGUUGUCUUCGACAUGGGUAAUCCUCAUGGUUCGAAAGCCGGUUUUCUUUGAUGUCACGGAAC |
| SEQ ID NO: 75<br>MS2 crRNA 1<br>(mini array)<br>mutant pos 7 | GGGGUUGGUAAGCCGGUUUUCUUUGAUGUCACGGAACCUUUGUUGUCUUCGACAUGGGUAAUCCUCAUGGUUGGUAAGCCGGUUUUCUUUGAUGUCACGGAAC |
| SEQ ID NO: 76<br>MS2 crRNA 1<br>(mini array)<br>mutant pos 9 | GGGGUUGGAAUGCCGGUUUUCUUUGAUGUCACGGAACCUUUGUUGUCUUCGACAUGGGUAAUCCUCAUGGUUGGAAUGCCGGUUUUCUUUGAUGUCACGGAAC |
| SEQ ID NO: 77<br>MS2 crRNA 1<br>(mini array)<br>mutant pos 11 | GGGGUUGGAAAGGCGGUUUUCUUUGAUGUCACGGAACCUUUGUUGUCUUCGACAUGGGUAAUCCUCAUGGUUGGAAAGGCGGUUUUCUUUGAUGUCACGGAAC |
| SEQ ID NO: 78<br>MS2 crRNA 1<br>(mini array)<br>mutant pos 13 | GGGGUUGGAAAGCCCGUUUUCUUUGAUGUCACGGAACCUUUGUUGUCUUCGACAUGGGUAAUCCUCAUGGUUGGAAAGCCCGUUUUCUUUGAUGUCACGGAAC |
| SEQ ID NO: 79<br>MS2 crRNA 1<br>(mini array)<br>mutant pos 15 | GGGGUUGGAAAGCCGGAUUUCUUUGAUGUCACGGAACCUUUGUUGUCUUCGACAUGGGUAAUCCUCAUGGUUGGAAAGCCGGAUUUCUUUGAUGUCACGGAAC |
| SEQ ID NO: 80<br>MS2 crRNA 1<br>(mini array)<br>mutant pos 17 | GGGGUUGGAAAGCCGGUUUAUCUUUGAUGUCACGGAACCUUUGUUGUCUUCGACAUGGGUAAUCCUCAUGGUUGGAAAGCCGGUUUAUCUUUGAUGUCACGGAAC |
| SEQ ID NO: 81<br>MS2 crRNA 1<br>(mini array)<br>mutant pos 19 | GGGGUUGGAAAGCCGGUUUUGUUUGAUGUCACGGAACCUUUGUUGUCUUCGACAUGGGUAAUCCUCAUGGUUGGAAAGCCGGUUUUGUUUGAUGUCACGGAAC |
| SEQ ID NO: 82<br>MS2 crRNA 1<br>(mini array)<br>mutant pos 21 | GGGGUUGGAAAGCCGGUUUUCUAUGAUGUCACGGAACCUUUGUUGUCUUCGACAUGGGUAAUCCUCAUGGUUGGAAAGCCGGUUUUCUAUGAUGUCACGGAAC |
| SEQ ID NO: 83<br>MS2 crRNA 1<br>(mini array)<br>mutant pos 23 | GGGGUUGGAAAGCCGGUUUUCUUUCAUGUCACGGAACCUUUGUUGUCUUCGACAUGGGUAAUCCUCAUGGUUGGAAAGCCGGUUUUCUUUCAUGUCACGGAAC |
| SEQ ID NO: 84<br>MS2 crRNA 1<br>(mini array)<br>mutant pos 25 | GGGGUUGGAAAGCCGGUUUUCUUUGAAGUCACGGAACCUUUGUUGUCUUCGACAUGGGUAAUCCUCAUGGUUGGAAAGCCGGUUUUCUUUGAAGUCACGGAAC |
| SEQ ID NO: 85<br>MS2 crRNA 1<br>(mini array)<br>mutant pos 27 | GGGGUUGGAAAGCCGGUUUUCUUUGAUGACACGGAACCUUUGUUGUCUUCGACAUGGGUAAUCCUCAUGGUUGGAAAGCCGGUUUUCUUUGAUGACACGGAAC |
| SEQ ID NO: 86<br>MS2 crRNA 1<br>(mini array)<br>mutant pos 29 | GGGGUUGGAAAGCCGGUUUUCUUUGAUGUCUCGGAACCUUUGUUGUCUUCGACAUGGGUAAUCCUCAUGGUUGGAAAGCCGGUUUUCUUUGAUGUCUCGGAAC |

TABLE 5-continued

| Target | Sequence |
|---|---|
| SEQ ID NO: 87 MS2 crRNA 1 (mini array) mutant pos 31 | GGGGUUGGAAAGCCGGUUUUCUUUGAUGUCACCGAACCUUUGUUGUCUUCGACAUGGGUAAUCCUCAUGGUUGGAAAGCCGGUUUUCUUUGAUGUCACCGAAC |
| SEQ ID NO: 88 MS2 crRNA 1 (mini array) mutant pos 33 | GGGGUUGGAAAGCCGGUUUUCUUUGAUGUCACGGUACCUUUGUUGUCUUCGACAUGGGUAAUCCUCAUGGUUGGAAAGCCGGUUUUCUUUGAUGUCACGGUAC |
| SEQ ID NO: 89 MS2 crRNA 1 (mini array) mutant pos 35 | GGGGUUGGAAAGCCGGUUUUCUUUGAUGUCACGGUAGCUUUGUUGUCUUCGACAUGGGUAAUCCUCAUGGUUGGAAAGCCGGUUUUCUUUGAUGUCACGGUAG |
| SEQ ID NO: 90 MS2 crRNA 1 (mini array) WT | GGGGUUGGAAAGCCGGUUUUCUUUGAUGUCACGGAACCUUUGUUGUCUUCGACAUGGGUAAUCCUCAUGGUUGGAAAGCCGGUUUUCUUUGAUGUCACGGAAC |
| SEQ ID NO: 91 MS2 crRNA 1 (mini array) double mutant pos 11 | GGGGUUGGAAAGGGGGUUUUCUUUGAUGUCACGGAACCUUUGUUGUCUUCGACAUGGGUAAUCCUCAUGGUUGGAAAGGGGGUUUUCUUUGAUGUCACGGAAC |
| SEQ ID NO: 92 MS2 crRNA 1 (mini array) double mutant pos 14 | GGGGUUGGAAAGCCGCAUUUCUUUGAUGUCACGGAACCUUUGUUGUCUUCGACAUGGGUAAUCCUCAUGGUUGGAAAGCCGCAUUUCUUUGAUGUCACGGAAC |
| SEQ ID NO: 93 MS2 crRNA 1 (mini array) double mutant pos 17 | GGGGUUGGAAAGCCGGUUAACUUUGAUGUCACGGAACCUUUGUUGUCUUCGACAUGGGUAAUCCUCAUGGUUGGAAAGCCGGUUAACUUUGAUGUCACGGAAC |
| SEQ ID NO: 94 MS2 crRNA 1 (mini array) double mutant pos 19 | GGGGUUGGAAAGCCGGUUUUGAUUGAUGUCACGGAACCUUUGUUGUCUUCGACAUGGGUAAUCCUCAUGGUUGGAAAGCCGGUUUUGAUUGAUGUCACGGAAC |
| SEQ ID NO: 95 MS2 crRNA 1 (mini array) double mutant pos 22 | GGGGUUGGAAAGCCGGUUUUCUUACAUGUCACGGAACCUUUGUUGUCUUCGACAUGGGUAAUCCUCAUGGUUGGAAAGCCGGUUUUCUUACAUGUCACGGAAC |
| SEQ ID NO: 96 MS2 crRNA 1 (mini array) double mutant pos 25 | GGGGUUGGAAAGCCGGUUUUCUUUGAACUCACGGAACCUUUGUUGUCUUCGACAUGGGUAAUCCUCAUGGUUGGAAAGCCGGUUUUCUUUGAACUCACGGAAC |
| SEQ ID NO: 97 MS2 crRNA 1 (mini array) double mutant pos 28 | GGGGUUGGAAAGCCGGUUUUCUUUGAUGUGUCGGAACCUUUGUUGUCUUCGACAUGGGUAAUCCUCAUGGUUGGAAAGCCGGUUUUCUUUGAUGUGUCGGAAC |
| SEQ ID NO: 98 MS2 crRNA 1 (mini array) double mutant pos 31 | GGGGUUGGAAAGCCGGUUUUCUUUGAUGUCACCCAACCUUUGUUGUCUUCGACAUGGGUAAUCCUCAUGGUUGGAAAGCCGGUUUUCUUUGAUGUCACCCAAC |
| SEQ ID NO: 99 MS2 crRNA 1 (mini array) double mutant pos 34 | GGGGUUGGAAAGCCGGUUUUCUUUGAUGUCACGGAUGCUUUGUUGUCUUCGACAUGGGUAAUCCUCAUGGUUGGAAAGCCGGUUUUCUUUGAUGUCACGGAUG |
| SEQ ID NO: 100 SARS-COV2 SSRNA | GGGAAAUCAGCGAAAUGCACCCCGCAUUACGUUUGGUGGACCCUCAGAUUCAACUGGCAGUAACCAGAAUGGAGAACGCAGUGGGGCGCGAUCAAAACAACGUCGGCCCCAAGGUUUACCCAAUAAUACUGCGUCUUGGUUCACCGCUCUCAC |

TABLE 5-continued

| Target | Sequence |
|---|---|
| SEQ ID NO: 101<br>Influenza A<br>segment 4 HA<br>gene | GGGAUUCUAUGUCUGGUUUUCGCUCAAAAACUUCCCGGAAAUGACAACAGCA<br>CGGCAACGCUGUGCCUUGGGCACCAUGCAGUACCAAACGGAACGAUAGUGAA<br>AACAAUCACGAAUGACCAAAUUGAAGUCACUAAUGCUACUGAACUGGUU |
| SEQ ID NO: 102<br>34-nt MS2<br>ssRNA target | GGGATGAGGATTACCCATGTCGAAGACAACAAAG |
| SEQ ID NO: 103<br>EGFP ssRNA<br>100 nt | AUGCCCGCCAUGAAGAUCGAGUGCCGCAUCACCGGCACCCUGAACGGCGUGGA<br>GUUCGAGCUGGUGGGCGGCGGAGAGGGCACCCCCGAGCAGGGCCGCA |
| SEQ ID NO: 104<br>EGFP ssRNA<br>200 nt | AUGCCCGCCAUGAAGAUCGAGUGCCGCAUCACCGGCACCCUGAACGGCGUGGA<br>GUUCGAGCUGGUGGGCGGCGGAGAGGGCACCCCCGAGCAGGGCCGCAUGACC<br>AACAAGAUGAAGAGCACCAAAGGCGCCCUGACCUUCAGCCCCUACCUGCUGAG<br>CCACGUGAUGGGCUACGGCUUCUACCACUUCGGCACCUACCC |
| SEQ ID NO: 105<br>EGFP ssRNA<br>600 nt | AUGCCCGCCAUGAAGAUCGAGUGCCGCAUCACCGGCACCCUGAACGGCGUGGA<br>GUUCGAGCUGGUGGGCGGCGGAGAGGGCACCCCCGAGCAGGGCCGCAUGACC<br>AACAAGAUGAAGAGCACCAAAGGCGCCCUGACCUUCAGCCCCUACCUGCUGAG<br>CCACGUGAUGGGCUACGGCUUCUACCACUUCGGCACCUACCCCAGCGGCUACG<br>AGAACCCCUUCCUGCACGCCAUCAACAACGGCGGCUACACCAACACCCGCAUC<br>GAGAAGUACGAGGACGGCGGCGUGCUGCACGUGAGCUUCAGCUACCGCUACG<br>AGGCCGGCCGCGUGAUCGGCGACUUCAAGGUGGUGGGCACCGGCUUCCCCGAG<br>GACAGCGUGAUCUUCACCGACAAGAUCAUCCGCAGCAACGCCACCGUGGAGCA<br>CCUGCACCCCAUGGGCGAUAACGUGCUGGUGGGCAGCUUCGCCCGCACCUUCA<br>GCCUGCGCGACGGCGGCUACUACAGCUUCGUGGUGGACAGCCACAUGCACUUC<br>AAGAGCGCCAUCCACCCCAGCAUCCUGCAGAACGGGGGCCCCAUGUUCGCCUU<br>CCGCCGCGUGGAGGAGCUG |
| SEQ ID NO: 106<br>60 nt MS2<br>SSRNA | CCGGCCAUUCAAACAUGAGGAUUACCCAUGUCGAAGACAACAAAGAAGUUCA<br>ACUCUUUA |
| SEQ ID NO: 107<br>ssRNA 1 with<br>right PFS | GGCCAGUGAAUUCGAGCUCGGUACCCGGGGAUCCUCUAGAAAUAUGGAUUAC<br>UUGgUAGAACAGCAAUCUACUCGNNNNNNACCUGCAGGCAUGCAAGCUUGGC<br>GUAAUCAUGGUCAUAGCUGUUUCCUGUGUUUAUCCGCUCACAAUUCCACACA<br>ACAUACGAG CCGGAAGCAU |
| SEQ ID NO: 108<br>ssRNA 1 with<br>left PFS | GGCCAGUGAAUUCGAGCUCGGUACCCGGGGAUCCUCUAGAAAUANNNNNNUG<br>GAUUACUUGgUAGAACAGCAAUCUACUCGACCUGCAGGCAUGCAAGCUUGGCG<br>UAAUCAUGGUCAUAGCUGUUUCCUGUGUUUAUCCGCUCACAAUUCCACACAA<br>CAUACGAGCCGGAAGCAU |
| SEQ ID NO: 109<br>31-nt MS2<br>ssRNA target | GGGAUGAGGAUUACCCAUGUCGAAGACAACAAAG |
| SEQ ID NO: 110<br>MS2 ssDNA and<br>dsDNA target | CCGGCATCTACTAATAGACGCCGGCCATTCAAACATGAGGATTACCCATGTCGA<br>AGACAACAAAGAAGTTCAACTCTTTATGTATTGATCTTCCTCGCGA |

Table 6 below shows examples of crRNA for in vitro assays.

TABLE 6

| Name | SEQ ID NO | DR sequence | SEQ ID NO | Spacer sequence |
|---|---|---|---|---|
| SSRNA crRNA 5 | 111 | GGTTGGAAAGCCGGTTTTCTT<br>TGATGTCACGGAAC | 112 | CGAGTAGATTGCTGTTCTacC<br>AAGTAATCCA |
| SSRNA crRNA 1 | 113 | GGTTGGAAAGCCGGTTTTCTT<br>TGATGTCACGGAAC | 114 | TATGCTTCCGGCTCGTATGT<br>TGTGTGGAATT |
| SSRNA crRNA 2 | 115 | GGTTGGAAAGCCGGTTTTCTT<br>TGATGTCACGGAAC | 116 | AACACAGGAAACAGCTATG<br>ACCATGATTACG |
| SSRNA crRNA 3 | 117 | GGTTGGAAAGCCGGTTTTCTT<br>TGATGTCACGGAAC | 118 | AATTGTGAGCGGATAAACA<br>CAGGAAACAGCT |
| SSRNA crRNA 4 | 119 | GGTTGGAAAGCCGGTTTTCTT<br>TGATGTCACGGAAC | 120 | TTGCTGTTCTacCAAGTAATC<br>CATATTTCTA |

TABLE 6-continued

| Name | SEQ ID NO | DR sequence | SEQ ID NO | Spacer sequence |
| --- | --- | --- | --- | --- |
| SSRNA crRNA 6 | 121 | GGTTGGAAAGCCGGTTTTCTT TGATGTCACGGAAC | 122 | TTTCTAGAGGATCCCCGGGT ACCGAGCTCGA |
| non targeting crRNA | 123 | GGTTGGAAAGCCGGTTTTCTT TGATGTCACGGAAC | 124 | CGCCAATATAACAATACAG GTATTATAGTTG |
| MS2 guide 1 | 125 | GGTTGGAAAGCCGGTTTTCTT TGATGTCACGGAAC | 126 | CTTTGTTGTCTTCGACATGG GTAATCCTCAT |
| MS2 guide 2 | 127 | GGTTGGAAAGCCGGTTTTCTT TGATGTCACGGAAC | 128 | CTTCTTTGTTGTCTTCGACA TGGGTAATCCT |
| MS2 guide 3 | 129 | GGTTGGAAAGCCGGTTTTCTT TGATGTCACGGAAC | 130 | TAAAGAGTTGAACTTCTTTG TTGTCTTCGAC |
| MS2 guide 4 | 131 | GGTTGGAAAGCCGGTTTTCTT TGATGTCACGGAAC | 132 | TCTTTGTTGTCTTCGACATG GGTAATCCTCA |
| MS2 additional spacer 1 | 133 | GGTTGGAAAGCCGGTTTTCTT TGATGTCACGGAAC | 134 | TAATCCTCATGTTTGAATGG CCGGCGTCTAT |
| MS2 additiona spacer 2 | 135 | GGTTGGAAAGCCGGTTTTCTT TGATGTCACGGAAC | 136 | TTCGACATGGGTAATCCTCA TGTTTGAATGG |
| MS2 additional spacer 3 | 137 | GGTTGGAAAGCCGGTTTTCTT TGATGTCACGGAAC | 138 | CGAGGAAGATCAATACATA AAGAGTTGAACT |
| MS2 additional spacer 4 | 139 | GGTTGGAAAGCCGGTTTTCTT TGATGTCACGGAAC | 140 | TGGTAAATTTCGAGAGAAA GATCGCGAGGAA |
| MS2 additional spacer 5 | 141 | GGTTGGAAAGCCGGTTTTCTT TGATGTCACGGAAC | 142 | TTGAATGGCCGGCGTCTATT AGTAGATGCCG |
| fixed position SSRNA 1 150 nt guide 1 | 143 | GGTTGGAAAGCCGGTTTTCTT TGATGTCACGGAAC | 144 | AATCCATATTTCTAGAGGAT CCCCGGGTACC |
| fixed position SSRNA 1 150 nt guide 2 | 145 | GGTTGGAAAGCCGGTTTTCTT TGATGTCACGGAAC | 146 | TGTTCTACCAAGTAATCCAT ATTTCTAGAGG |
| fixed position SSRNA 1 150 nt guide 3 | 147 | GGTTGGAAAGCCGGTTTTCTT TGATGTCACGGAAC | 148 | TCGAGTAGATTGCTGTTCTA CCAAGTAATCC |
| fixed position SSRNA 1 150nt guide 4 | 149 | GGTTGGAAAGCCGGTTTTCTT TGATGTCACGGAAC | 150 | GCATGCCTGCAGGTCGAGT AGATTGCTGTTC |
| fixed position SSRNA 1 150 nt guide 5 | 151 | GGTTGGAAAGCCGGTTTTCTT TGATGTCACGGAAC | 152 | TTACGCCAAGCTTGCATGCC TGCAGGTCGAG |
| fixed position SSRNA 1 150 nt guide 6 | 153 | GGTTGGAAAGCCGGTTTTCTT TGATGTCACGGAAC | 154 | GCTATGACCATGATTACGCC AAGCTTGCATG |

TABLE 6-continued

| Name | SEQ ID NO | DR sequence | SEQ ID NO | Spacer sequence |
|---|---|---|---|---|
| fixed position MS2 guide 1 | 155 | GGTTGGAAAGCCGGTTTTCTT TGATGTCACGGAAC | 156 | AATCCTCATGTTTGAATGGC CGGCGTCTATT |
| fixed position MS2 guide 2 | 157 | GGTTGGAAAGCCGGTTTTCTT TGATGTCACGGAAC | 158 | CTTCGACATGGGTAATCCTC ATGTTTGAATG |
| fixed position MS2 guide 3 | 159 | GGTTGGAAAGCCGGTTTTCTT TGATGTCACGGAAC | 160 | ACTTCTTTGTTGTCTTCGAC ATGGGTAATCC |
| fixed position MS2 guide 4 | 161 | GGTTGGAAAGCCGGTTTTCTT TGATGTCACGGAAC | 162 | CATAAAGAGTTGAACTTCTT TGTTGTCTTCG |
| fixed position MS2 guide 5 | 163 | GGTTGGAAAGCCGGTTTTCTT TGATGTCACGGAAC | 164 | AGGAAGATCAATACATAAA GAGTTGAACTTC |
| fixed position MS2 guide 6 | 165 | GGTTGGAAAGCCGGTTTTCTT TGATGTCACGGAAC | 166 | GAGAAAGATCGCGAGGAAG ATCAATACATAA |
| EGFP guide 1 | 167 | GGTTGGAAAGCCGGTTTTCTT TGATGTCACGGAAC | 168 | AGGGTGCCGGTGATGCGGC ACTCGATCTTCA |
| EGFP guide 2 | 169 | GGTTGGAAAGCCGGTTTTCTT TGATGTCACGGAAC | 170 | CCAGCTCGAACTCCACGCC GTTCAGGGTGCC |
| EGFP guide 3 | 171 | GGTTGGAAAGCCGGTTTTCTT TGATGTCACGGAAC | 172 | CCCTCTCCGCCGCCCACCAG CTCGAACTCCA |
| EGFP guide 4 | 173 | GGTTGGAAAGCCGGTTTTCTT TGATGTCACGGAAC | 174 | CGGCCCTGCTCGGGGGTGC CCTCTCCGCCGC |
| EGFP guide 5 | 175 | GGTTGGAAAGCCGGTTTTCTT TGATGTCACGGAAC | 176 | ACGTGGCTCAGCAGGTAGG GGCTGAAGGTCA |
| EGFP guide 6 | 177 | GGTTGGAAAGCCGGTTTTCTT TGATGTCACGGAAC | 178 | AGGTGCCGAAGTGGTAGAA GCCGTAGCCCAT |
| EGFP guide 7 | 179 | GGTTGGAAAGCCGGTTTTCTT TGATGTCACGGAAC | 180 | TGGCGTGCAGGAAGGGGTT CTCGTAGCCGCT |
| EGFP guide 8 | 181 | GGTTGGAAAGCCGGTTTTCTT TGATGTCACGGAAC | 182 | GTACTTCTCGATGCGGGTGT TGGTGTAGCCG |
| EGFP guide 9 | 183 | GGTTGGAAAGCCGGTTTTCTT TGATGTCACGGAAC | 184 | GCGGCCGGCCTCGTAGCGG TAGCTGAAGCTC |
| EGFP guide 10 | 185 | GGTTGGAAAGCCGGTTTTCTT TGATGTCACGGAAC | 186 | AAGCCGGTGCCCACCACCTT GAAGTCGCCGA |
| EGFP guide 11 | 187 | GGTTGGAAAGCCGGTTTTCTT TGATGTCACGGAAC | 188 | AAGATCACGCTGTCCTCGG GGAAGCCGGTGC |
| GwCas7-11c MS2 crRNA | 189 | GTTTGGAAGCCGGGTCGAAG TCAGGCCCGTTAAGAC | 190 | CTTTGTTGTCTTCGACATGG GTAATCCTCAT |
| CjcCas7-11b MS2 crRNA | 191 | cttgaagactaaaggaaggaa ttaatgtcacggtac | 192 | CTTTGTTGTCTTCGACATGG GTAATCCTCAT |
| GwCas7-11c non-targeting crRNA | 193 | GTTTGGAAGCCGGGTCGAAG TCAGGCCCGTTAAGAC | 194 | CGCCAATATAACAATACAG GTATTATAGTTG |
| CjcCas7-11b non-targeting crRNA | 195 | cttgaagactaaaggaaggaa ttaatgtcacggtac | 196 | CGCCAATATAACAATACAG GTATTATAGTTG |
| MS2 crRNA DR length | 197 | GTTGGAAAGCCGGTTTTCTTT GATGTCACGGAAC | 198 | CTTTGTTGTCTTCGACATGG GTAATCCTCAT |
| MS2 crRNA DR length | 199 | GGAAAGCCGGTTTTCTTTGAT GTCACGGAAC | 200 | CTTTGTTGTCTTCGACATGG GTAATCCTCAT |

TABLE 6-continued

| Name | SEQ ID NO | DR sequence | SEQ ID NO | Spacer sequence |
| --- | --- | --- | --- | --- |
| MS2 crRNA DR length | 201 | AAGCCGGTTTTCTTTGATGTCACGGAAC | 202 | CTTTGTTGTCTTCGACATGGGTAATCCTCAT |
| MS2 crRNA DR length | 203 | CCGGTTTTCTTTGATGTCACGGAAC | 204 | CTTTGTTGTCTTCGACATGGGTAATCCTCAT |
| MS2 crRNA DR length | 205 | GTTTTCTTTGATGTCACGGAAC | 206 | CTTTGTTGTCTTCGACATGGGTAATCCTCAT |
| MS2 crRNA DR length | 207 | TCTTTGATGTCACGGAAC | 208 | CTTTGTTGTCTTCGACATGGGTAATCCTCAT |
| MS2 crRNA DR length | 209 | TTGATGTCACGGAAC | 210 | CTTTGTTGTCTTCGACATGGGTAATCCTCAT |
| MS2 crRNA DR length | 211 | ATGTCACGGAAC | 212 | CTTTGTTGTCTTCGACATGGGTAATCCTCAT |
| MS2 crRNA DR length | 213 | TCACGGAAC | 214 | CTTTGTTGTCTTCGACATGGGTAATCCTCAT |
| MS2 crRNA DR length | 215 | CGGAAC | 216 | CTTTGTTGTCTTCGACATGGGTAATCCTCAT |
| MS2 crRNA spacer length | 217 | GGTTGGAAAGCCGGTTTTCTTTGATGTCACGGAAC | 218 | CTTTGTTGTCTTCGACATGGGTAATCCTCA |
| MS2 crRNA spacer length | 219 | GGTTGGAAAGCCGGTTTTCTTTGATGTCACGGAAC | 220 | CTTTGTTGTCTTCGACATGGGTAATCCT |
| MS2 crRNA spacer length | 221 | GGTTGGAAAGCCGGTTTTCTTTGATGTCACGGAAC | 222 | CTTTGTTGTCTTCGACATGGGTAAT |
| MS2 crRNA spacer length | 223 | GGTTGGAAAGCCGGTTTTCTTTGATGTCACGGAAC | 224 | CTTTGTTGTCTTCGACATGGGT |
| MS2 crRNA spacer length | 225 | GGTTGGAAAGCCGGTTTTCTTTGATGTCACGGAAC | 226 | CTTTGTTGTCTTCGACATG |
| MS2 crRNA spacer length | 227 | GGTTGGAAAGCCGGTTTTCTTTGATGTCACGGAAC | 228 | CTTTGTTGTCTTCGAC |
| MS2 crRNA spacer length | 229 | GGTTGGAAAGCCGGTTTTCTTTGATGTCACGGAAC | 230 | CTTTGTTGTCTTC |
| MS2 crRNA spacer length | 231 | GGTTGGAAAGCCGGTTTTCTTTGATGTCACGGAAC | 232 | CTTTGTTGTC |
| MS2 crRNA 1 DR WT | 233 | TTGATGTCACGGAAC | 234 | CTTTGTTGTCTTCGACATGGGTAATCCTCAT |
| MS2 crRNA 1 DR mutant 1 | 235 | ATGATGTCACGGAAC | 236 | CTTTGTTGTCTTCGACATGGGTAATCCTCAT |
| MS2 crRNA 1 DR mutant 2 | 237 | TAGATGTCACGGAAC | 238 | CTTTGTTGTCTTCGACATGGGTAATCCTCAT |
| MS2 crRNA 1 DR mutant 3 | 239 | TTCATGTCACGGAAC | 240 | CTTTGTTGTCTTCGACATGGGTAATCCTCAT |
| MS2 crRNA 1 DR mutant 4 | 241 | TTGTTGTCACGGAAC | 242 | CTTTGTTGTCTTCGACATGGGTAATCCTCAT |
| MS2 crRNA 1 DR mutant 5 | 243 | TTGAAGTCACGGAAC | 244 | CTTTGTTGTCTTCGACATGGGTAATCCTCAT |
| MS2 crRNA 1 DR mutant 6 | 245 | TTGATCTCACGGAAC | 246 | CTTTGTTGTCTTCGACATGGGTAATCCTCAT |

TABLE 6-continued

| Name | SEQ ID NO | DR sequence | SEQ ID NO | Spacer sequence |
|---|---|---|---|---|
| MS2 crRNA 1 DR mutant 7 | 247 | TTGATGACACGGAAC | 248 | CTTTGTTGTCTTCGACATGGGTAATCCTCAT |
| MS2 crRNA 1 DR mutant 8 | 249 | TTGATGTGACGGAAC | 250 | CTTTGTTGTCTTCGACATGGGTAATCCTCAT |
| MS2 crRNA 1 DR mutant 9 | 251 | TTGATGTCTCGGAAC | 252 | CTTTGTTGTCTTCGACATGGGTAATCCTCAT |
| MS2 crRNA 1 DR mutant 10 | 253 | TTGATGTCAGGGAAC | 254 | CTTTGTTGTCTTCGACATGGGTAATCCTCAT |
| MS2 crRNA 1 DR mutant 11 | 255 | TTGATGTCACCGAAC | 256 | CTTTGTTGTCTTCGACATGGGTAATCCTCAT |
| MS2 crRNA 1 DR mutant 12 | 257 | TTGATGTCACGCAAC | 258 | CTTTGTTGTCTTCGACATGGGTAATCCTCAT |
| MS2 crRNA 1 DR mutant 13 | 259 | TTGATGTCACGGTAC | 260 | CTTTGTTGTCTTCGACATGGGTAATCCTCAT |
| MS2 crRNA 1 DR mutant 14 | 261 | TTGATGTCACGGATC | 262 | CTTTGTTGTCTTCGACATGGGTAATCCTCAT |
| MS2 crRNA 1 DR mutant 15 | 263 | TTGATGTCACGGAAG | 264 | CTTTGTTGTCTTCGACATGGGTAATCCTCAT |
| MS2 crRNA 1 DR WT | 265 | TTGATGTCACGGAAC | 266 | CTTTGTTGTCTTCGACATGGGTAATCCTCAT |
| MS2 crRNA 1 DR double mutant 1 | 267 | AAGATGTCACGGAAC | 268 | CTTTGTTGTCTTCGACATGGGTAATCCTCAT |
| MS2 crRNA 1 DR double mutant 2 | 269 | TACATGTCACGGAAC | 270 | CTTTGTTGTCTTCGACATGGGTAATCCTCAT |
| MS2 crRNA 1 DR double mutant 3 | 271 | TTCTTGTCACGGAAC | 272 | CTTTGTTGTCTTCGACATGGGTAATCCTCAT |
| MS2 crRNA 1 DR double mutant 4 | 273 | TTGTAGTCACGGAAC | 274 | CTTTGTTGTCTTCGACATGGGTAATCCTCAT |
| MS2 crRNA 1 DR double mutant 5 | 275 | TTGAACTCACGGAAC | 276 | CTTTGTTGTCTTCGACATGGGTAATCCTCAT |
| MS2 crRNA 1 DR double mutant 6 | 277 | TTGATCACACGGAAC | 278 | CTTTGTTGTCTTCGACATGGGTAATCCTCAT |
| MS2 crRNA 1 DR double mutant 7 | 279 | TTGATGAGACGGAAC | 280 | CTTTGTTGTCTTCGACATGGGTAATCCTCAT |
| MS2 crRNA 1 DR double mutant 8 | 281 | TTGATGTGTCGGAAC | 282 | CTTTGTTGTCTTCGACATGGGTAATCCTCAT |
| MS2 crRNA 1 DR double mutant 9 | 283 | TTGATGTCTGGGAAC | 284 | CTTTGTTGTCTTCGACATGGGTAATCCTCAT |

TABLE 6-continued

| Name | SEQ ID NO | DR sequence | SEQ ID NO | Spacer sequence |
|---|---|---|---|---|
| MS2 crRNA 1 DR double mutant 10 | 285 | TTGATGTCAGCGAAC | 286 | CTTTGTTGTCTTCGACATGGGTAATCCTCAT |
| MS2 crRNA 1 DR double mutant 11 | 287 | TTGATGTCACCCAAC | 288 | CTTTGTTGTCTTCGACATGGGTAATCCTCAT |
| MS2 crRNA 1 DR double mutant 12 | 289 | TTGATGTCACGCTAC | 290 | CTTTGTTGTCTTCGACATGGGTAATCCTCAT |
| MS2 crRNA 1 DR double mutant 13 | 291 | TTGATGTCACGGTTC | 292 | CTTTGTTGTCTTCGACATGGGTAATCCTCAT |
| MS2 crRNA 1 DR double mutant 14 | 293 | TTGATGTCACGGATG | 294 | CTTTGTTGTCTTCGACATGGGTAATCCTCAT |
| COVID-19 N gene crRNA 1 | 295 | GGTTGGAAAGCCGGTTTTCTTTGATGTCACGGAAC | 296 | ACCAAACGTAATGCGGGGTGCATTTCGCTGA |
| COVID-19 N gene crRNA 2 | 297 | GGTTGGAAAGCCGGTTTTCTTTGATGTCACGGAAC | 298 | GTTGAATCTGAGGGTCCACCAAACGTAATGC |
| COVID-19 N gene crRNA 3 | 299 | GGTTGGAAAGCCGGTTTTCTTTGATGTCACGGAAC | 300 | CATTCTGGTTACTGCCAGTTGAATCTGAGGG |
| COVID-19 N gene crRNA 4 | 301 | GGTTGGAAAGCCGGTTTTCTTTGATGTCACGGAAC | 302 | GCCCCACTGCGTTCTCCATTCTGGTTACTGC |
| COVID-19 N gene crRNA 5 | 303 | GGTTGGAAAGCCGGTTTTCTTTGATGTCACGGAAC | 304 | ACGTTGTTTTGATCGCGCCCCACTGCGTTCT |
| COVID-19 N gene crRNA 6 | 305 | GGTTGGAAAGCCGGTTTTCTTTGATGTCACGGAAC | 306 | GGTAAACCTTGGGGCCGACGTTGTTTTGATC |
| COVID-19 N gene crRNA 7 | 307 | GGTTGGAAAGCCGGTTTTCTTTGATGTCACGGAAC | 308 | AGACGCAGTATTATTGGGTAAACCTTGGGGC |
| COVID-19 N gene crRNA 8 | 309 | GGTTGGAAAGCCGGTTTTCTTTGATGTCACGGAAC | 310 | TGAGAGCGGTGAACCAAGACGCAGTATTATT |
| Influenza A segment 4 HA gene crRNA 1 | 311 | GGTTGGAAAGCCGGTTTTCTTTGATGTCACGGAAC | 312 | CCGGGAAGTTTTTGAGCGAAAACCAGACATA |
| Influenza A segment 4 HA gene crRNA 2 | 313 | GGTTGGAAAGCCGGTTTTCTTTGATGTCACGGAAC | 314 | CGTGCTGTTGTCATTTCCGGGAAGTTTTTGA |
| Influenza A segment 4 HA gene crRNA 3 | 315 | GGTTGGAAAGCCGGTTTTCTTTGATGTCACGGAAC | 316 | CAAGGCACAGCGTTGCCGTGCTGTTGTCATT |
| Influenza A segment 4 HA gene crRNA 4 | 317 | GGTTGGAAAGCCGGTTTTCTTTGATGTCACGGAAC | 318 | GGTACTGCATGGTGCCCAAGGCACAGCGTTG |
| Influenza A segment 4 HA gene crRNA 5 | 319 | GGTTGGAAAGCCGGTTTTCTTTGATGTCACGGAAC | 320 | TCACTATCGTTCCGTTTGGTACTGCATGGTG |

TABLE 6-continued

| Name | SEQ ID NO | DR sequence | SEQ ID NO | Spacer sequence |
| --- | --- | --- | --- | --- |
| Influenza A segment 4 HA gene crRNA 6 | 321 | GGTTGGAAAGCCGGTTTTCTT TGATGTCACGGAAC | 322 | GTCATTCGTGATTGTTTTCA CTATCGTTCCG |
| Influenza A segment 4 HA gene crRNA 7 | 323 | GGTTGGAAAGCCGGTTTTCTT TGATGTCACGGAAC | 324 | AGTGACTTCAATTTGGTCAT TCGTGATTGTT |
| Influenza A segment 4 HA gene crRNA 8 | 325 | GGTTGGAAAGCCGGTTTTCTT TGATGTCACGGAAC | 326 | ACCAGTTCAGTAGCATTAGT GACTTCAATTT |
| EGFP guide 12 | 327 | GGTTGGAAAGCCGGTTTTCTT TGATGTCACGGAAC | 328 | TGGGGTGCAGGTGCTCCAC GGTGGCGTTGCT |
| EGFP guide 13 | 329 | GGTTGGAAAGCCGGTTTTCTT TGATGTCACGGAAC | 330 | AAGGTGCGGGCGAAGCTGC CCACCAGCACGT |
| EGFP guide 14 | 331 | GGTTGGAAAGCCGGTTTTCTT TGATGTCACGGAAC | 332 | GTCCACCACGAAGCTGTAG TAGCCGCCGTCG |
| EGFP guide 15 | 333 | GGTTGGAAAGCCGGTTTTCTT TGATGTCACGGAAC | 334 | TGCTGGGGTGGATGGCGCT CTTGAAGTGCAT |
| EGFP guide 16 | 335 | GGTTGGAAAGCCGGTTTTCTT TGATGTCACGGAAC | 336 | GGAAGGCGAACATGGGGCC CCCGTTCTGCAG |
| MS2 tiling guide 1 | 337 | GGTTGGAAAGCCGGTTTTCTT TGATGTCACGGAAC | 338 | AATCCTCATGTTTGAATGGC CGGCGTCTATT |
| MS2 tiling guide 2 | 339 | GGTTGGAAAGCCGGTTTTCTT TGATGTCACGGAAC | 340 | GGTAATCCTCATGTTTGAAT GGCCGGCGTCT |
| MS2 tiling guide 3 | 341 | GGTTGGAAAGCCGGTTTTCTT TGATGTCACGGAAC | 342 | ATGGGTAATCCTCATGTTTG AATGGCCGGCG |
| MS2 tiling guide 4 | 343 | GGTTGGAAAGCCGGTTTTCTT TGATGTCACGGAAC | 344 | GACATGGGTAATCCTCATGT TTGAATGGCCG |
| MS2 tiling guide 5 | 345 | GGTTGGAAAGCCGGTTTTCTT TGATGTCACGGAAC | 346 | TTCGACATGGGTAATCCTCA TGTTTGAATGG |
| MS2 tiling guide 6 | 347 | GGTTGGAAAGCCGGTTTTCTT TGATGTCACGGAAC | 348 | GTCTTCGACATGGGTAATCC TCATGTTTGAA |
| MS2 tiling guide 7 | 349 | GGTTGGAAAGCCGGTTTTCTT TGATGTCACGGAAC | 350 | GTTGTCTTCGACATGGGTAA TCCTCATGTTT |
| MS2 tiling guide 8 | 351 | GGTTGGAAAGCCGGTTTTCTT TGATGTCACGGAAC | 352 | TTTGTTGTCTTCGACATGGG TAATCCTCATG |
| MS2 tiling guide 9 | 353 | GGTTGGAAAGCCGGTTTTCTT TGATGTCACGGAAC | 354 | TTCTTTGTTGTCTTCGACAT GGGTAATCCTC |
| MS2 tiling guide 10 | 355 | GGTTGGAAAGCCGGTTTTCTT TGATGTCACGGAAC | 356 | AACTTCTTTGTTGTCTTCGA CATGGGTAATC |
| Cjc MS2 60 bp ssRNA crRNA 1 | 357 | CTTGAAGACTAAAGGAAGGA ATTAATGTCACGGTAC | 358 | AATCCTCATGTTTGAATGGC CGGCGTCTATT |
| Cjc MS2 60 bp ssRNA crRNA 2 | 359 | CTTGAAGACTAAAGGAAGGA ATTAATGTCACGGTAC | 360 | GGTAATCCTCATGTTTGAAT GGCCGGCGTCT |
| Cjc MS2 60 bp ssRNA crRNA 3 | 361 | CTTGAAGACTAAAGGAAGGA ATTAATGTCACGGTAC | 362 | ATGGGTAATCCTCATGTTTG AATGGCCGGCG |
| Cjc MS2 60 bp ssRNA crRNA 4 | 363 | CTTGAAGACTAAAGGAAGGA ATTAATGTCACGGTAC | 364 | GACATGGGTAATCCTCATGT TTGAATGGCCG |

TABLE 6-continued

| Name | SEQ ID NO | DR sequence | SEQ ID NO | Spacer sequence |
|---|---|---|---|---|
| Cjc MS2 60 bp ssRNA crRNA 5 | 365 | CTTGAAGACTAAAGGAAGGAATTAATGTCACGGTAC | 366 | TTCGACATGGGTAATCCTCATGTTTGAATGG |
| Cjc MS2 60 bp ssRNA crRNA 6 | 367 | CTTGAAGACTAAAGGAAGGAATTAATGTCACGGTAC | 368 | GTCTTCGACATGGGTAATCCTCATGTTTGAA |
| Cjc MS2 60 bp ssRNA crRNA 7 | 369 | CTTGAAGACTAAAGGAAGGAATTAATGTCACGGTAC | 370 | GTTGTCTTCGACATGGGTAATCCTCATGTTT |
| Cjc MS2 60 bp ssRNA crRNA 8 | 371 | CTTGAAGACTAAAGGAAGGAATTAATGTCACGGTAC | 372 | TTTGTTGTCTTCGACATGGGTAATCCTCATG |
| Cjc MS2 60 bp ssRNA crRNA 9 | 373 | CTTGAAGACTAAAGGAAGGAATTAATGTCACGGTAC | 374 | TTCTTTGTTGTCTTCGACATGGGTAATCCTC |
| Cjc MS2 60 bp ssRNA crRNA 10 | 375 | CTTGAAGACTAAAGGAAGGAATTAATGTCACGGTAC | 376 | AACTTCTTTGTTGTCTTCGACATGGGTAATC |
| Cjc MS2 60 bp ssRNA crRNA 11 | 377 | CTTGAAGACTAAAGGAAGGAATTAATGTCACGGTAC | 378 | TTGAACTTCTTTGTTGTCTTCGACATGGGTA |
| Gw MS2 60 bp ssRNA crRNA 1 | 379 | GTTTGGAAGCCGGGTCGAAGTCAGGCCCGTTAAGAC | 380 | AAACGTAATGCGGGGTGCATTTCGCTGATTT |
| Gw MS2 60 bp ssRNA crRNA 2 | 381 | GTTTGGAAGCCGGGTCGAAGTCAGGCCCGTTAAGAC | 382 | ACCAAACGTAATGCGGGGTGCATTTCGCTGA |
| Gw MS2 60 bp ssRNA crRNA 3 | 383 | GTTTGGAAGCCGGGTCGAAGTCAGGCCCGTTAAGAC | 384 | TCCACCAAACGTAATGCGGGGTGCATTTCGC |
| Gw MS2 60 bp ssRNA crRNA 4 | 385 | GTTTGGAAGCCGGGTCGAAGTCAGGCCCGTTAAGAC | 386 | GGGTCCACCAAACGTAATGCGGGGTGCATTT |
| Gw MS2 60 bp ssRNA crRNA 5 | 387 | GTTTGGAAGCCGGGTCGAAGTCAGGCCCGTTAAGAC | 388 | TGAGGGTCCACCAAACGTAATGCGGGGTGCA |
| Gw MS2 60 bp ssRNA crRNA 6 | 389 | GTTTGGAAGCCGGGTCGAAGTCAGGCCCGTTAAGAC | 390 | ATCTGAGGGTCCACCAAACGTAATGCGGGGT |
| Gw MS2 60 bp ssRNA crRNA 7 | 391 | GTTTGGAAGCCGGGTCGAAGTCAGGCCCGTTAAGAC | 392 | TGAATCTGAGGGTCCACCAAACGTAATGCGG |
| Gw MS2 60 bp ssRNA crRNA 8 | 393 | GTTTGGAAGCCGGGTCGAAGTCAGGCCCGTTAAGAC | 394 | AGTTGAATCTGAGGGTCCACCAAACGTAATG |
| Gw MS2 60 bp ssRNA crRNA 9 | 395 | GTTTGGAAGCCGGGTCGAAGTCAGGCCCGTTAAGAC | 396 | GCCAGTTGAATCTGAGGGTCCACCAAACGTA |
| Gw MS2 60 bp ssRNA crRNA 10 | 397 | GTTTGGAAGCCGGGTCGAAGTCAGGCCCGTTAAGAC | 398 | ACTGCCAGTTGAATCTGAGGGTCCACCAAAC |
| Gw MS2 60 bp ssRNA crRNA 11 | 399 | GTTTGGAAGCCGGGTCGAAGTCAGGCCCGTTAAGAC | 400 | GTTACTGCCAGTTGAATCTGAGGGTCCACCA |

Table 7 below shows examples of mammalian plasmids.

TABLE 7

| Plasmid number | Name | Benchling link |
|---|---|---|
| pDF0158 | pCMV-huDsiGRAMP N term msfGFP mammalian expression | https://benchling.com/s/seq-16V8YUC36yaVMw4GYawz |
| pDF0159 | pCMV-huDsiGRAMP mammalian expression | https://benchling.com/s/seq-V4NVwiioQSHLp6fkKY5I |
| pDF0160 | pCMV-huDsiGRAMP C term msfGFP mammalian expression | https://benchling.com/s/seq-6KYYZvPGjqOWNIPwLN2u |
| pDF0113 | pU6-Eco31i-Eco31i-DsiCas7-11a full DR guide scaffold with golden gate site | https://benchling.com/s/seq-fl07Vm8NmTi2ydJnbZGS |
| pDF0114 | pU6-Eco31i-Eco31i-DsiCas7-11a mature DR guide scaffold with golden gate site | https://benchling.com/s/seq-22EWyWJAvvfpX2EsdJxs |
| pDF0111 | CMV-Cluciferase(STOP85)-polyA EF1a-G-luciferase-polyA (pAB0040) | https://benchling.com/s/seq-9fEQxFBZrIEQo8Ta407A |
| pDF0112 | CMV-Cluciferase-polyA EF1a-G-luciferase-polyA | https://benchling.com/s/seq-QDT25JIo4luxluesN196 |
| pDF0234 | pCMV-huDsiGRAMP (5' UTR from BE constructs) dead mutant | https://benchling.com/s/seq-cNh21gwflmDV66VanySf |
| pDF0237 | pCMV-dead huDsiGRAMP-NES-huADAR2 | https://benchling.com/s/seq-OKxBeGoAOWuk6GbgfAa2 |
| pDF0228 | pCMV-huDsiGRAMP-NES-huADAR2 | https://benchling.com/s/seq-BnKsJ4pko0RcknikJMlr |

Table 8 below shows examples of Cas7-11 guides for mammalian.

TABLE 8

| SEQ ID NO | Name | Spacer sequence | Target | Application (Knockdown/editing) |
|---|---|---|---|---|
| 401 | DsiGRAMP mammalian guide 1 F | Gluc GCAGATCAGGGCAAACAGAACTTTGACTCCC | Gluc | Knockdown |
| 402 | DsiGRAMP mammalian guide 2 F | Gluc CGATGTTGAAGTCTTCGTTGTTCTCGGTGGG | Gluc | Knockdown |
| 403 | DsiGRAMP mammalian guide 3 F | Gluc GCAACTTCCCGCGGTCAGCATCGAGATCCGT | Gluc | Knockdown |
| 404 | DsiGRAMP mammalian guide 4 F | Gluc TGCAGCCAGCTTTCCGGGCATTGGCTTCCAT | Gluc | Knockdown |
| 405 | DsiGRAMP mammalian guide 5 F | Gluc TGAACTTCTTCATCTTGGGCGTGCACTTGAT | Gluc | Knockdown |
| 406 | DsiGRAMP mammalian guide 6 F | Gluc GAATGTCGACGATCGCCTCGCCTATGCCGCC | Gluc | Knockdown |
| 407 | DsiGRAMP mammalian guide 7 F | Gluc ATGAACTGCTCCATGGGCTCCAAGTCCTTGA | Gluc | Knockdown |
| 408 | DsiGRAMP mammalian guide 8 F | Gluc GCAGCCAGTTGTGCAGTCCACACACAGATCG | Gluc | Knockdown |
| 409 | DsiGRAMP mammalian guide 9 F | Gluc GCGTTGCGGCAGCCACTTCTTGAGCAGGTCA | Gluc | Knockdown |
| 410 | DsiGRAMP mammalian guide 10 F | Gluc TGTCCACCTGGCCCTGGATCTTGCTGGCAAA | Gluc | Knockdown |
| 411 | DsiGRAMP mammalian targeting 1 F | Non- GGTAATGCCTGGCTTGTCGACGCATAGTCTG | Gluc | Knockdown |
| 412 | DsiGRAMP mammalian targeting 2 F | Non- GGGAACCTTGGCCGTTATAAAGTCTGACCAG | Gluc | Knockdown |
| 413 | KRAS guide 1 | TATAATGGTGAATATCTTCAAATGATTTAGT | KRAS | Knockdown |
| 414 | KRAS guide 2 | ATGTATAGAAGGCATCATCAACACCCTGTCT | KRAS | Knockdown |

TABLE 8-continued

| SEQ ID NO | Name | Spacer sequence | Target | Application (Knockdown/ editing) |
|---|---|---|---|---|
| 415 | KRAS guide 3 | GGTTAAAAATTTACAGATT GTGCTGAGCTTG | KRAS | Knockdown |
| 416 | PPIB guide 1 | GTAGATGCTCTTTCCTCCTG TGCCATCTCCC | PPIB | Knockdown |
| 417 | PPIB guide 2 | CAGTTTGAAGTTCTCATCG GGGAAGCGCTCA | PPIB | Knockdown |
| 418 | PPIB guide 3 | CAGTGTTGGTAGGAGTTTG TTACAAAAGTGA | PPIB | Knockdown |
| 419 | MALAT1 guide 1 | CTTGGCCAAGTCTGTTATGT TCACCTGAAAA | MALAT1 | Knockdown |
| 420 | MALAT1 guide 2 | CAAAATGTACTCAGCTTCA ATCACAAATACG | MALAT1 | Knockdown |
| 421 | MALAT1 guide 3 | GGTTATAGCTTGACAAGCA ATTAACTTTAAA | MALAT1 | Knockdown |
| 422 | CXCR4 guide 1 | ATGATAATGCAATAGCAGG ACAGGATGACAA | CXCR4 | Knockdown |
| 423 | Non-targeting 1 | GGTAATGCCTGGCTTGTCG ACGCATAGTCTG | — | Knockdown |
| 424 | Non-targeting 2 | GGGAACCTTGGCCGTTATA AAGTCTGACCAG | — | Knockdown |
| 425 | Cluc W85X guide MM1 | CATCCTGCGGCCTCTACTCT GCATTCAATTACATACTGA CACATTCGGCA | Cluc | Editing |
| 426 | Cluc W85X guide MM3 | ACCATCCTGCGGCCTCTAC TCTGCATTCAATTACATACT GACACATTCGG | Cluc | Editing |
| 427 | Cluc W85X guide MM5 | AAACCATCCTGCGGCCTCT ACTCTGCATTCAATTACAT ACTGACACATTC | Cluc | Editing |
| 428 | Cluc W85X guide MM7 | CTAAACCATCCTGCGGCCT CTACTCTGCATTCAATTACA TACTGACACAT | Cluc | Editing |
| 429 | Cluc W85X guide MM9 | TTCTAAACCATCCTGCGGC CTCTACTCTGCATTCAATTA CATACTGACAC | Cluc | Editing |
| 430 | Cluc W85X guide MM11 | TGTTCTAAACCATCCTGCG GCCTCTACTCTGCATTCAAT TACATACTGAC | Cluc | Editing |
| 431 | Cluc W85X guide MM13 | AATGTTCTAAACCATCCTG CGGCCTCTACTCTGCATTCA ATTACATACTG | Cluc | Editing |
| 432 | Cluc W85X guide MM15 | AGAATGTTCTAAACCATCC TGCGGCCTCTACTCTGCATT CAATTACATAC | Cluc | Editing |
| 433 | Cluc W85X guide MM17 | ATAGAATGTTCTAAACCAT CCTGCGGCCTCTACTCTGC ATTCAATTACAT | Cluc | Editing |
| 434 | Cluc W85X guide MM19 | CCATAGAATGTTCTAAACC ATCCTGCGGCCTCTACTCTG CATTCAATTAC | Cluc | Editing |
| 435 | Cluc W85X guide MM21 | TTCCATAGAATGTTCTAAA CCATCCTGCGGCCTCTACTC TGCATTCAATT | Cluc | Editing |

TABLE 8-continued

| SEQ ID NO | Name | Spacer sequence | Target | Application (Knockdown/editing) |
|---|---|---|---|---|
| 436 | Cluc W85X guide MM23 | CTTTCCATAGAATGTTCTAAACCATCCTGCGGCCTCTACTCTGCATTCAA | Cluc | Editing |
| 437 | Cluc W85X guide MM25 | CTCTTTCCATAGAATGTTCTAAACCATCCTGCGGCCTCTACTCTGCATTC | Cluc | Editing |
| 438 | Cluc W85X guide MM27 | ATCTCTTTCCATAGAATGTTCTAAACCATCCTGCGGCCTCTACTCTGCAT | Cluc | Editing |
| 439 | Cluc W85X guide MM29 | GAATCTCTTTCCATAGAATGTTCTAAACCATCCTGCGGCCTCTACTCTGC | Cluc | Editing |
| 440 | Cluc W85X guide MM31 | TGGAATCTCTTTCCATAGAATGTTCTAAACCATCCTGCGGCCTCTACTCT | Cluc | Editing |
| 441 | Cluc W85X guide MM33 | ACTGGAATCTCTTTCCATAGAATGTTCTAAACCATCCTGCGGCCTCTACT | Cluc | Editing |
| 442 | Cluc W85X guide MM35 | GAACTGGAATCTCTTTCCATAGAATGTTCTAAACCATCCTGCGGCCTCTA | Cluc | Editing |
| 443 | Cluc W85X guide MM37 | TGGAACTGGAATCTCTTTCCATAGAATGTTCTAAACCATCCTGCGGCCTC | Cluc | Editing |
| 444 | Cluc W85X guide MM39 | CCTGGAACTGGAATCTCTTTCCATAGAATGTTCTAAACCATCCTGCGGCC | Cluc | Editing |
| 445 | Cluc W85X guide MM41 | TTCCTGGAACTGGAATCTCTTTCCATAGAATGTTCTAAACCATCCTGCGG | Cluc | Editing |
| 446 | Cluc W85X guide MM43 | GGTTCCTGGAACTGGAATCTCTTTCCATAGAATGTTCTAAACCATCCTGC | Cluc | Editing |
| 447 | LwaCas13a guide for comparison | ACCCAGGAATCTCAGGAATGTCGACGAT | Gluc | Knockdown |
| 448 | PspCas13b guide for comparison | GGGCATTGGCTTCCATCTCTTTGAGCACCT | Gluc | Knockdown |
| 449 | RfxCas13d guide for comparison | ACCCAGGAATCTCAGGAATGTCGACGAT | Gluc | Knockdown |
| 450 | shRNA guide for comparison | AAAGTTCTGTTTGCCCTGATCCTCGAGGATCAGGGCAAACAGAACTTT | Gluc | Knockdown |

Table 9 shows the representative Cas7-11 orthologs of FIG. 1F.

TABLE 9

| SEQ ID NO/NAME | SEQUENCE |
|---|---|
| SEQ ID NO: 451 MBD3181016.1 | RDMATSAHTTIDKETKRTKENHLINLEVVRIEDN-RYLKGSVEMIN- |
| SEQ ID NO: 452 MBC8521845.1 | DQVRTSAHNKINRATGRVEKDLLFSYELG--ANT-VPLEGTIERVNP |

TABLE 9-continued

| SEQ ID NO/ NAME | SEQUENCE |
|---|---|
| SEQ ID NO: 453 RCV63412.1 | DMVRTSTHNKISRATGRVEKDHLFSYELG--ANT-TPFEGMIEPVNH |
| SEQ ID NO: 454 MBC8461765.1 | GTTRVSLHNRVDPTTGRVPEETFFSFEVG--SAE-K-FTGRIERSGP |
| SEQ ID NO: 455 HHR29383.1 | EPIRISTHNRIDPATGRVPKDLLFTFEMG--SPA-V-FRGYIERIGI |
| SEQ ID NO: 456 WP_129889723.1 | LQTFLYTQARLDRPTRTAVPGALYSSEFG--LRE-ITFKGSVTGWLE |
| SEQ ID NO: 457 WP_174676620.1 | NQKDVYTQVRLDRPTRTAVEGALYTSEFG--TRG-LTFHGDITGSLT |
| SEQ ID NO: 458 TFH44231.1 | LFLNTRTGTKIDRRTGTVQEDHLFTTESG--IKG-ITLTSKIYGRGN |
| SEQ ID NO: 459 MAT45258.1 | YGQSIRSNNRIDPKTRTAANDHLFFTECV--DPD-TYFIGEIRSSSN |
| SEQ ID NO: 460 WP_075063448.1 | YGRLLRTGIGIDRKLRVVVPDRLFTNECV--GTK-IPFTGRIIGEFP |
| SEQ ID NO: 461 HreCas7-11 | EIAVSRVVNRVDPNSGKA-KDFFRVWEID--HKLCPNFLGKMSISLS |
| SEQ ID NO: 462 CmaCas7-11 | DIVQKRILNRVDQTCGKA-KDFFKVCEVD--HIACPTLNGIIRINDE |
| SEQ ID NO: 463 HvmCas7-11 | ETAIERIVNRVDPSSGKA-KDYMRIWEID--PLVCSQFNGIITIN-- |
| SEQ ID NO: 464 SmCas7-11 | EIGSRRTINRVDDETGKA-HDFFSIWEVD--A--VREFQGEIVLAAD |
| SEQ ID NO: 465 OmCas7-11 | EIGRLRTLNRIDRLTTKA-QDFFRIYEVD--Q--VRDFFGTITLAGD |
| SEQ ID NO: 466 DisCas7-11 | AIGSQRVLNRVDFKSGKA-HDFFKAYEVD--HTRFPRFEGEITIDNK |
| SEQ ID NO: 467 DsbaCas7-11 | EIAVRRVVNRVDYASGKA-HDFFRIFEVD--HIAFPCFHGEIAFGEN |
| SEQ ID NO: 468 SstCas7-11 | DIGTQRTLNRVDYATGKA-HDFFKVWEID--HSLLSVFQGKISIADN |
| SEQ ID NO: 469 CsbCas7-11 | DIASGRILNRVDFDTGKA-KDYFRTWEAD--YETYGTYTGRITLRNE |
| SEQ ID NO: 470 CjcCas7-11 | DIASERILNRVDYTTGKA-HDYFKVWEVD--DDQWWQFTGTITMHDD |
| SEQ ID NO: 471 CbfCas7-11 | DVCKERVLNRVDFRTGKA-QDYFRVFEID--HEDWGVYTGEITITEP |
| SEQ ID NO: 472 HvsCas7-11 | ELAPKRALNRIEQYTGKA-QDYFTVYEAL--NKEFWTFKGRIRIKED |
| SEQ ID NO: 473 HsmCas7-11 | EIGIRRILNRVDFTTGKA-QDYFYVWEVE--HSMCPKFQGTVKINED |
| SEQ ID NO: 474 FmCas7-11 | DIAQKRTSNRVDFFSKKA-HDHYGVWEVT--A--VKNLLGYIYISDA |
| SEQ ID NO: 475 DpbaCas7-11 | QLIRPRILNRMDPGTSKA-RDYFRVFEIE--NQLCSQFRGWIWLSGD |

Table 10 shows the representative Cas7-11 orthologs of FIG. 1G.

TABLE 10

| SEQ ID NO/ NAME | SEQUENCE |
| --- | --- |
| SEQ ID NO: 476 WmCas7x3 | QRI----------------TPDAPDADP-YWQADIALDADGRPYLPG |
| SEQ ID NO: 477 NisCas7x3 | EEMDKQSG-----------ESVDKKQNN-SWIQAIALDLNKKPYIPG |
| SEQ ID NO: 478 GwCas7x3 | E------------------KERDENKET-RWLEAVALDHKGQPYIPG |
| SEQ ID NO: 479 HvmCas7x3 | VTRP---------------ELTVADRDELVDINAVVTDYTGKPYLPG |
| SEQ ID NO: 480 DsbCas7x3 | TDRPGLEI-----------EQKDGSKVK-AEINAFIKDSNGKPYLPG |
| SEQ ID NO: 481 Gam:Cas7x3 | IPVT---I-----------KDTQGKNRE-VEVNSVITGKAALPIIPG |
| SEQ ID NO: 482 DesCas7x3 | VEHD---------------LIKNDDGTP-VQINALITGAGGLPIIPG |
| SEQ ID NO: 483 GabCas7x3 | AEIE---I-----------NDSQGDRRQ-VQANAIIRGKDDKPIIPG |
| SEQ ID NO: 484 MetCas7x3 | CEHD---------------DVKNNDGEP-VKINACIKGSKGRPIIPG |
| SEQ ID NO: 485 MebCas7x3 | CYRP---------------ELTNADQKP-VDINACIKGANNLPIIPG |
| SEQ ID NO: 486 GwCas7-11 | -----------------EGQKQTDDQAE-SLHLRTLRDGHGRFRIPF |
| SEQ ID NO: 487 HreCas7-11 | ----------------------SEGQTS----QAIILCPDGSYRLPR |
| SEQ ID NO: 488 CmaCas7-11 | ----------------------KTSHTR----STIFLNMNGQFCIPR |
| SEQ ID NO: 489 HvmCas7-11 | ----------------------QEGQTS----ATILLNRDGYFRLPR |
| SEQ ID NO: 490 SmCas7-11 | --------------------PIDDDQTS----SRTL VDRDGRYRLPR |
| SEQ ID NO: 491 OmCas7-11 | ---------------------GSHDHTS----RKILLTRDFYYRLPR |
| SEQ ID NO: 492 DisCas7-11 | --------------------EDAKQTD----LQVLLTPDNKYRLPR |
| SEQ ID NO: 493 DsbaCas7-11 | --------------------KEKKQTD----LMLLLDGQNHYRIPR |
| SEQ ID NO: 494 SstCas7-11 | --------------------EDAKHTN----LKVLLDRQNRYRLPR |
| SEQ ID NO: 495 SybCas7-11 | --------------------GAGGHTD----LSILLGKDGHYRVPR |
| SEQ ID NO: 496 CsbCas7-11 | SDSIPGKEK------KSEDSLVINEHTS----FNILLDKENRYRIPR |
| SEQ ID NO: 497 CjcCas7-11 | FDSTQDDLDLVPDIVNTDEKLEANEQTS----FRILMDKKGRYRIPR |
| SEQ ID NO: 498 CbfCas7-11 | ------------------EQTEEVEHTS----LRLVMDKKGRFRIPR |
| SEQ ID NO: 499 HvsCas7-11 | ---------------------DEEKAE----GAILLTPDNRFRLPR |
| SEQ ID NO: 500 HsmCas7-11 | --------------------KTEEQID----MQILLTKDGRYRLPR |

TABLE 10-continued

| SEQ ID NO/ NAME | SEQUENCE |
|---|---|
| SEQ ID NO: 501 FmCas7-11 | --------------------QAGKQTS----MPTLQDSNDHFRLPR |
| SEQ ID NO: 502 DpbaCas7-11 | --------------------ATETHTD----LPILLTSDRHFRIPR |

Table 11 shows the representative Cas7-11 orthologs of FIG. 1H.

TABLE 11

| SEQ ID NO/ NAME | SEQUENCE |
|---|---|
| SEQ ID NO: 503 WxxCas7x3 | HRKPQDNAPDGTPRQRGDRA---------------LLPGASLRGRLRS |
| SEQ ID NO: 504 NisCas7x3 | KKDEAKNEADAKPRTNHQGQV--------------ILPASSLRGRLRA |
| SEQ ID NO: 505 GwCas7x3 | KADDADAV----PRRTHDDKI--------------VLPASSLRGRLRT |
| SEQ ID NO: 506 HvmCas7x3 | KKKRRSNTPNLRPLRDAIGRP--------------CLPESSVRGALRA |
| SEQ ID NO: 507 DsbCas7x3 | KKRKED--IDHQPLRDSAGNA--------------RLPAKSIRGAMRS |
| SEQ ID NO: 508 CamCas7x3 | DKCKAEDTPDIYPLEEKNGVP--------------AFPVRSFRGAIRS |
| SEQ ID NO: 509 DesCas7x3 | NTPDITQAPDMVPLVDEDGNP--------------MLPASSFRGALRA |
| SEQ ID NO: 510 GabCas7x3 | SKGDGDQPAVHQPLTDRSNNP--------------ILPARSFRGAIRA |
| SEQ ID NO: 511 MetCas7x3 | LSSNENAKTDHYPLLDKNRNP--------------YLPVSSFRGVLRS |
| SEQ ID NO: 512 MebCas7x3 | LEADPKTKIDHYPLLDNHKKP-------------RLPSASIRGVLRS |
| SEQ ID NO: 513 GwCas7-11 | ESDAPDNVAYKKPVVQYDETGRLRTTDPGPVEMLTCLKGEGVRGVVAY |
| SEQ ID NO: 514 HreCas7-11 | DHDNKDAVMVQKTVLFVDESG------NYSQMPHHFLKGSGIRGACRF |
| SEQ ID NO: 515 CmaCas7-11 | DNRNPDAVMVKKTILVYEQDSSTHKNVPKEVPKY-FIKSETIRGLLRS |
| SEQ ID NO: 516 HvmCas7-11 | DPRNTDAIMVRKTVFCPDPNA---KNRPAPATVY-MIKGESIRGILRS |
| SEQ ID NO: 517 SmCas7-11 | NSDTADIISFRRTVVDNGEVL------REP-----VLRGEGLRGLLRT |
| SEQ ID NO: 518 OmCas7-11 | -RHEEDSVYFQKRIFTSDGRV-----VLVP-----ALRGEGLRGLLRT |
| SEQ ID NO: 519 DisCas7-11 | DKRGTDVVTFVKYKAEGEEAK------PVC-----AYKAESFRGVIRS |
| SEQ ID NO: 520 DsbaCas7-11 | TEDVADIVSFKKYTQGGEKIIY------------AYKSESFRGVVRT |
| SEQ ID NO: 521 SstCas7-11 | EKDGSDIVSFRKYADDSGKEVY------------AYKAESFRGVVRA |
| SEQ ID NO: 522 SybCas7-11 | ERIGFDNIAYEKRRYNGETNT------TESIP---AVKGETFRGIVRT |

TABLE 11-continued

| SEQ ID NO/ NAME | SEQUENCE |
|---|---|
| SEQ ID NO: 523 CsbCas7-11 | EPGNRDAIAYKKRVYNDGNNA------IEPEPRF-AVKSETHRGIFRT |
| SEQ ID NO: 524 CjcCas7-11 | NKDNIDCIAYEKRKWENGGIK------FVP-----TIKGETIRGIVRM |
| SEQ ID NO: 525 CbfCas7-11 | DPNNVDAIVFEKMKLDGDQVK------YLP-----AIKGETIRGIVRT |
| SEQ ID NO: 526 HvsCas7-11 | EGKAPDAVFFKKYVFENGKIE------EKP-----CFKAESIRGIFRT |
| SEQ ID NO: 527 HsmCas7-11 | DSSNTDLVTFKKYKLEESKEVF------------AIKGESIRGVFRT |
| SEQ ID NO: 528 FmCas7-11 | -HGNTDSVFYKKPILKSGEKE------PSYQW---AIKSDTVRGLIRS |
| SEQ ID NO: 529 DpbaCas7-11 | -RNESDAVFYQKSVAGEKGPVY------------ALKGEGLRGIVSS |

Table 12 shows the representative Cas7-11 orthologs of FIG. 1I.

TABLE 12

| SEQ ID NO/ NAME | SEQUENCE |
|---|---|
| SEQ ID NO: 530 WmCas7x3 | PATLVDHDMLAIDRFTGGGKDGAKFK----LRYAECP-TLEGQLSLDL |
| SEQ ID NO: 531 NisCas7x3 | LATLTRHEMVAIDRFTGGGKEGAKFN----VDYIECP-TLTGAIYLDL |
| SEQ ID NO: 532 GwCas7x3 | SIKTRRHEMLAIDRFTGGGKDGAKFN----VDYVECP-TLAGKLSLDL |
| SEQ ID NO: 533 HvmCas7x3 | EDCDNIQEFVAIDRFTGGAKDKAKFN----AEYIGSP-RFTGTIALDK |
| SEQ ID NO: 534 DsbCas7x3 | TRQETVQDFVAIDRFHGGGKETAKFD----ASFSWRP-QYSILMHIPS |
| SEQ ID NO: 535 GamCas7x3 | LKPFIIQEFVAIDRFHGGGKDEAKFN----AAHYQAP-VFKGKVRVSQ |
| SEQ ID NO: 536 DesCas7x3 | FRREQEQTFVAIDRFHGGCKEGALYT----IRHAESP-RFEGHLVIDP |
| SEQ ID NO: 537 GabCas7x3 | YRPAKTQQFVAIDRFHGGGKDGALFS----IKYFERP-VLKGGISLKL |
| SEQ ID NO: 538 MetCas7x3 | KSKKTKQDFVAIDRFHGGGKDGAKFD----ATHFERP-EFEGAISFSP |
| SEQ ID NO: 539 MebCas7x3 | ANELKTQEFIAIDRFHGGGKDGAKFN----AKHSERP-YFQGRITLSP |
| SEQ ID NO: 540 GwCas7-11 | TPHAMRSDRVALDVF-GGAMPEAKFDDRPLAASPGKPLNFKSTIWYRE |
| SEQ ID NO: 541 HreCas7-11 | EVEAIKCDHVAIDRFHGGTVHRMKYDDYPLPGSPNRPLRIKGNIWVKR |
| SEQ ID NO: 542 CmaCas7-11 | NVSDCCIDHVAIDRFTGGGVEKMKFNDYPLSASPKNCLNLKGSIWITS |
| SEQ ID NO: 543 HvmCas7-11 | SVSDKKMDHVAIDRFTGGGVDQMKFDDYPLPGCPAQPLILEGKFWVKD |
| SEQ ID NO: 544 SmCas7-11 | TVADKRLDHVAIDRFDQSVVE--KYDDRPLVGSPKQPLVFKGCFWVQT |

TABLE 12-continued

| SEQ ID NO/NAME | SEQUENCE |
|---|---|
| SEQ ID NO: 545 OmCas7-11 | TWNDKKIDHVSCSRFDASVVN--KFDDRSLVGSPDSPLHFEGTFWLHR |
| SEQ ID NO: 546 DisCas7-11 | DPEPVTFDHVAIDRFTGGAADKKKFDDSPLPGSPARPLMLKGSFWIRR |
| SEQ ID NO: 547 DsbaCas7-11 | EPEPRRFDHVAIDRFTGGAVNQKKFDDRSLVPGKEGFMTLIGCFWMRK |
| SEQ ID NO: 548 SstCas7-11 | QPEPMIFDHVAIDRFTGGAVDKKKFDDCSLPGTPGHPLTLKGCFWIRK |
| SEQ ID NO: 549 SybCas7-11 | AWTRKHLDHVAIDRFHGGAEENMKFDTYALAASPTNPLRMKGLIWVRS |
| SEQ ID NO: 550 CsbCas7-11 | EKLEKHIDHVAIDRFTGGALDKAKFDTYPLAGSPKKPLKLKGRFWIKK |
| SEQ ID NO: 551 CjcCas7-11 | SYKKKLIDHVAIDRFHGGAEDKMKFNTLPLAGSFEKPIILKGRFWIKK |
| SEQ ID NO: 552 CbfCas7-11 | KDIAKKIDHVAIDRFTGGARDQMKFDTLPLIGSPERPLRLKGLFWMRR |
| SEQ ID NO: 553 HvsCas7-11 | GQEEKFFDHVAIDRFLGGAKEKYKFDDKPIIGAPDTPIVLEGKIWVKK |
| SEQ ID NO: 554 HsmCas7-11 | DSAPKRLDHVAIDRFTGGAKEQAKFDDSPLIGSPDSPLEFTGIVWVRD |
| SEQ ID NO: 555 FmCas7-11 | EIKTYRMDHVAIDRISGGAVDQCKYDDEPLVGTSKHPLVFKGMFWINR |
| SEQ ID NO: 556 DpbaCas7-11 | EVREKLFDHVSIDRFTGGAANKLKFDDKPLVG---NPLVFQGVFWVHQ |

Table 13 shows the representative Cas7-11 orthologs of FIG. 1J.

TABLE 13

| SEQ ID NO\NAME | SEQUENCE |
|---|---|
| SEQ ID NO: 557 WmCas7x3 | PVAGFALQNQPAIPATSLRGLLSSLFESISGSNLRVLHPTPYSIRKTT |
| SEQ ID NO: 558 NisCas7x3 | EARPFKLNGKHAIPATSLRGMLSSLFESVSNSNFRVLHPEHYSVRKSL |
| SEQ ID NO: 559 GwCas7x3 | SLHPFKLNNGLAIPATSLRGMISSLFESVSNSNFRVLDEKTYSMRKTM |
| SEQ ID NO: 560 HvmCas7x3 | EILPFTLGGKPAIPATSLRGMLSSIAEAASNSSLRVLEDKTLSYRKSM |
| SEQ ID NO: 561 DsbCas7x3 | QVDHYTENGEIAIPATTLRGLLSSLSEAASNSSMRVLDDGMMSYRQPV |
| SEQ ID NO: 562 GamCas7x3 | LRHPYQLDGEPAIPSTSLRGLISTMTEAAANCAMRVLDSEIISYRKPM |
| SEQ ID NO: 563 DesCas7x3 | RIENYRLGNRIAIPAASLRGMLSSLAEAASNSAMRVLHQGILSYRKKA |
| SEQ ID NO: 564 GabCas7x3 | LKEHYQLNNKLAIPATSLRGLISSLAEAASNSALRVLDNGVLSYRKPA |
| SEQ ID NO: 565 MetCas7x3 | EINNYRLNGELAIPATSLRGMISSLAEAASNSAMRVLDNGLLSYRKTA |
| SEQ ID NO: 566 MebCas7x3 | ELDNYRLNGQLAIPATSLRGMISSLAEAASNSAMRVLDNGLLSYRKDA |

TABLE 13-continued

| SEQ ID NO\ NAME | SEQUENCE |
|---|---|
| SEQ ID NO: 567 GwCas7-11 | TQRFHQINDEIGLPGASLRGMVLSNYQILTNSCYRNLKATEEITRRMP |
| SEQ ID NO: 568 HreCas7-11 | NYRFFRINDELAIPGSELRGMVSSVYEALTNSCFRIMEEGRYLSRRMG |
| SEQ ID NO: 569 CmaCas7-11 | NYAFFRINDHIAIPGASIRGMISSVFETLTHSCFRVMDDKKYLTRRVI |
| SEQ ID NO: 570 HvmCas7-11 | NYGFFRINGNVAIPGSSIRGMISSVFEALTNSCFRVFDQERYLSRSEK |
| SEQ ID NO: 571 SmCas7-11 | NFPFFKINDEIMLPGAPLWAAVSQVYEALTNSCFRVMKQKRFLSWRME |
| SEQ ID NO: 572 OmCas7-11 | EYPSFRLNNTPMIPGAGLRAAVSQVYEVLTNSCIRIMDQGQTLSWRMS |
| SEQ ID NO: 573 DisCas7-11 | SYAFFRLHKQIMIPGSELRGMVSSVYETVTNSCFRIFDETKRLSWRMD |
| SEQ ID NO: 574 DsbaCas7-11 | SYRFFTLNRVPMIPGSEIRGMISSVFEALSNSCFRIFDEKYRLSWRMD |
| SEQ ID NO: 575 SstCas7-11 | SYAFFSVNGDIMLPGSEIRGMLSSVYEALTNSCFRVFDEGYRLSWRME |
| SEQ ID NO: 576 SybCas7-11 | MCKFFSVAGKPMIPGSEIRGMISSVYEALTNSCFRVFDEEKYLTRRVQ |
| SEQ ID NO: 577 CsbCas7-11 | NYKFFNINGELMIPGSELRGMLRTHFEALTKSCFAIFGEDSTLSWRMN |
| SEQ ID NO: 578 CjcCas7-11 | NYQFFHINDEIMVPGSEIRGMISSVYEAITNSCFRVYDETKYITRRLS |
| SEQ ID NO: 579 CbfCas7-11 | TYDFFQMNNAIMIPGSEIRGMISAVYEAMTNSCFRIFHEKQYLTRRIS |
| SEQ ID NO: 580 HvsCas7-11 | YYHFLKIDNKPIIPGAEIRGAVSSIYEALTNSCFRVFGEKKVLSWRME |
| SEQ ID NO: 581 HsmCas7-11 | VYKFFRLGGHLCIPAAEIRGMISSVYEALTNSCFRVFDEKRLISWRMT |
| SEQ ID NO: 582 FmCas7-11 | SFRFFRIDDEVLIPGSEIRGMVSTVFEALTGSCFRVINQKAHLSWRIN |
| SEQ ID NO: 583 DpbaCas7-11 | RFKFMRMGSQAAIPGSAIRSMTSSVFEALTNSCFRVLDQKSHLSWRME |

Table 14 shows the representative Cas7-11 orthologs of FIG. 1K.

TABLE 14

| SEQ ID NB\ NAME | SEQUENCE |
|---|---|
| SEQ ID NO: 584 WmCas7x3 | E-------------------ALSA--IGRI-VE----RNGELKLYPL |
| SEQ ID NO: 585 NisCas7x3 | DYV-----------------ALSA--MGRI-VD----DQGELKLQPL |
| SEQ ID NO: 586 GwCas7x3 | Q-------------------SLSA--MGRI-VR----HDQKLYLLPL |
| SEQ ID NO: 587 HvmCas7x3 | ANRN--------------EDKPLSA--LGMI-KKIETGDKVEYRLLPL |
| SEQ ID NO: 588 DsbCas7x3 | SG------------------SLSA--IGMV-VI----RDGKKFIYPL |

TABLE 14-continued

| SEQ ID NB\NAME | SEQUENCE |
|---|---|
| SEQ ID NO: 589 GamCas7x3 | PSH------------------ILSA--LGMV-TK----RGEDFWLIPL |
| SEQ ID NO: 590 DesCas7x3 | N--------------------ALRE--IGMI-VL----RDGKRFILPL |
| SEQ ID NO: 591 GabCas7x3 | R--------------------ALRK--IGIL-FK----REEQWRLVQM |
| SEQ ID NO: 592 MetCas7x3 | D--------------------ALRK--VGMV-IY----VDNKSFIIKL |
| SEQ ID NO: 593 MebCas7x3 | L--------------------ALSK--IGITFIN----RQGQWQLIPM |
| SEQ ID NO: 594 GwCas7-11 | DEA------------------KYRK--AGRV-TVSGDGAQKKYSIQEM |
| SEQ ID NO: 595 HreCas7-11 | D--------------------EFKDFHPGIV--------VDGAKIREM |
| SEQ ID NO: 596 CmaCas7-11 | ESETTQ-KRKSGRYQVEESDPDLF---PGRV-QK----KGNKYKIEKM |
| SEQ ID NO: 597 HvmCas7-11 | DPT------------------ELTKYYPGKV-KR----DGNKFFILKM |
| SEQ ID NO: 598 SmCas7-11 | E--------------------DYKDFYPGRV-------LDGGKQIKKM |
| SEQ ID NO: 599 OmCas7-11 | SEHK-----------------DYQ---PGKI-------TDNGRKIQPM |
| SEQ ID NO: 600 DisCas7-11 | DHQN-----------------VLQDFLPGRV-------TADGKHIQKF |
| SEQ ID NO: 601 DsbaCas7-11 | DVK------------------ELEQFKPGRV-------ADDGKRIEEM |
| SEQ ID NO: 602 SstCas7-11 | DRN------------------VLMQFKPGRV-------TDNGLRIEEM |
| SEQ ID NO: 603 SybCas7-11 | KKGA-----------------KSSELVPGII-VWG---QNGGLAVQQV |
| SEQ ID NO: 604 CsbCas7-11 | DEKDYKIDSNSIRKMESQRNPKYRI--PDEL-QKELRNSGNGLFNRLY |
| SEQ ID NO: 605 CjcCas7-11 | EKKD----ESNDKNKSQDDASQKIR---KGLV-KK----TDEGFSIIEV |
| SEQ ID NO: 606 CbfCas7-11 | EDK------------------ELREFIPGIV-RI----INGDVYIEKA |
| SEQ ID NO: 607 HvsCas7-11 | KDAK-----------------EFM---PGRV-SK----KKGKLYMVKM |
| SEQ ID NO: 608 HsmCas7-11 | EEAK----RPDPKKSEEQNRMRFR---PGRI-IK----KDKKFYAQEM |
| SEQ ID NO: 609 FmCas7-11 | DMAK-----------------HYR---PGRI-IQ----NNEKMFIQPY |
| SEQ ID NO: 610 DpbaCas7-11 | DDAG-----------------DYK---PGRF-EK----KDDKAVIRKF |

TABLE 15 shows sequence alignments of cas nucleases.

DOMAINS

Mutated residues; catalytic residues
Domain 1 - Csm3-like (group 7 RAMP) with abnormal "G-rich" loop
Domain 2 - putative small subunit (no sequence similarity but there is a conserved "W" and four large alpha
helices predicted by Jpred in this region)
Domain 3 - Csm3-like (group 7 RAMP), could be catalytic
Domain 4 - Csm3-like (group 7 RAMP), * - catalytic aspartates based on Zhu X, Ye K.
Nucleic Acids Res. 2015 Jan;43(2):1257-67; https://doi.org/10.1093/nar/gku1355
Domain 5 - Csm3-like with large insertion or subdomain (group 7 RAMP)
WmCas7x3, GwCas7x3, SER16298.1, PID64649.1, WP_031436019.1, HEB50754.1 - III-D systems

SECTION 1

SEQ ID NO: 611
WmCas7x3 ---------------------------------------------------------------------------------
---------------------------------------------------------------------------------
-------------------------

SEQ ID NO: 612
SER16298.1 -------------------------------------------------------------------------------
---------------------------------------------------------------------------------
-------------------------

SEQ ID NO: 613
GwCas7x3 ---------------------------------------------------------------------------------
---------------------------------------------------------------------------------
------------------------

SEQ ID NO: 614
PID64649.1 -------------------------------------------------------------------------------
---------------------------------------------------------------------------------
-------------------------

SEQ ID NO: 615
WP_031436019.1 ---------------------------------------------------------------------------
---------------------------------------------------------------------------------
-----------------------------

SEQ ID NO: 616
HEB50754.1 -------------------------------------------------------------------------------
---------------------------------------------------------------------------------
-------------------------

SEQ ID NO: 617
HreCas7-11 --MSVEEFYVRLTFL-EPFRVVPWVRNGDERKGDRIYQRGGTYARWHKI-----
NDSHGQPYITGTMLRSAVLREIENTLTLHNTY----GCCPGGT--RTTEGKLEKPL-YLRRRD--
GFEFENH-AEKPC-----SEEDPCPLCLIQGRFDKLRRDEKKQFVRQGNI-SFCSVNFSNLNISS---
GIKSFSWE---EI

SEQ ID NO: 618
CmaCas7-11 ----MLKLKVKITYF-QPFRVIPWIKEDDRNSDRN-YLRGGTFARWHKDKK---
DDIHGKPYITGTLLRSALFTEIEKIKIHHSDFIH---CCNAID----RTEGKHQPS-FLRKRP----
VYTENKNIQAC--------NKCPLCLIMGRGDDRGEDLKKKKHYNGKHYQNWTVHFSNFD------
TQATFYWK---DI

SEQ ID NO: 619
HvmCas7-11 ----MTQITIQVTFF-HPFRVVPWNHRDHRKTDRK-YLRGGTFAKWHCTAS---
EGKSGRPYITGTLLRSALFAEIEKLIAFHDPF----KCCRGKD---KTENGNAKPL-FLRRRP----------
RADC-----DPCGTCPLCLLMGRSDTVRRDAKKQKK-------DWSVHFCNLR-EA---TERSFNWK---ET

SEQ ID NO: 620
SmCas7x3 -----MRLKINIHFL-EPFRLIEWHEQDRRNKGNSRWQRGQSFARWHRRKD---NDQ-
GRPYITGTLLRSVVIRAVEEELARPDTAWQ---SCGGLF---ITPDGQTKPQ-HLRHRA--TVRARQT-
AKDKC---A-DRQSACPFCLLLGRFDQVGKDGDKKGEGL-----RFDVRFSNLD-LPKDFSPRDFDGPQ--
EI

SEQ ID NO: 621
oral_meta MIPDLRSLVVHISFL-TPYRQAPWFPPEKRRNNNRDWLRMQSYARWHKVAP---EE--
GHPFITGTLLRSRVIRAVEEELCLANGIWRGVACCPGEF----NSQAKKKPK-HLRRRT--TLQWYPE-
GAKSCSKQD-GRENACPFCLLLDRFGGEKSEEGRKKNN------DYDVHFSNLNPFYPGSSPKVWSGPE-
-EI SEQ ID NO: 622
DisCas7-11 ---MTTTMKISIEFL-EPFRMTKWQESTRRNKNNKEFVRGQAFARWHRNKK---
DNTKGRPYITGTLLRSAVIRSAENLLTLSDGKISEKTCCPGKF----DTEDKDRLL-QLRQRS--TLRWT---
DKNPC--PD-NAETYCPFCELLGRSGNDGKKAEKKDW-------RFRIHFGNLS-LP---GKPDFDGPK--AI TABLE 15-continued shows sequence alignments of cas nucleases.

SEQ ID NO: 623

```
DsbaCas7-11  -------MKITLRFL-EPFRMLDWIRPEERISGNKAFQRGLTFARWHKSKA---DDK-
GKPFITGTLLRSAVIRAAEHLLVLSKGKVGEKACCPGKFLTETDTETNKAPTMFLRKRP--TLKWT---
DRKGC-----DPDFPCPLCELLGPGAVGKKEGEAGI--------NSYVNFGNLS-FP---GDTGYSNAR--EI
```

SEQ ID NO: 624

```
SstCas7-11  -----MIINITVKFL-GPFRMLEWTDPDNRNRKNREFMRGQAFARWHNSNP---QKG-
SQPYITGTLVRSAVIRSAENLLMLSEGKVGKEKCCPGEF--RTENRKKRDAMLHLRQRS--TLQWKT--
DKPLC-----NGKSLCPICELLGRRIGKTDEVKKKG--------DFRIHFGNLT------PLNRYDDPS---DI
```

SEQ ID NO: 625

```
CsbCas7-11  -----MNITVELTFF-EPYRLVEWFDWDARKKSHS-AMRGQAFAQWTWKGK---
GRTAGKSFITGTLVRSAVIKAVEELLSLNNGKWEGVPCCNGSF--QTDESKGKKPS-FLRKRH--
TLQWQAN-NKNIC-----DKEEACPFCILLGRFDNAGKVHERNK--------DYDIHFSNFD-LD---
HKQEKNDLRLVDI
```

SEQ ID NO: 626

```
CjcCas7-11  ---MHTILPIHLTFL-EPYRLAEWHAKADRKKNKR-YLRGMSFAQWHKDKD---GI--
GKPYITGTLLRSAVLNAAEELISLNQGMWAKEPCCNGKF-----ETEKDKPA-VLRKRP--TIQWKTG-
RPAICDPEKQEKKDACPLCMLLGRFDKAGKRHRDNKYDKH----DYDIHFDNLN-LI---TDKKFSHPD--
DI
```

SEQ ID NO: 627

```
CbfCas7-11  MSKTDDKIDIKLTFL-EPYRMVNWLENGLRMTDPR-YLRGLSFARWHRNKN---
GKA-GRPYITGTLLRSAVIRAAEELLSLNLGKWGKQLCCPGQF--ETEREMRKNKT-FLRRRP--
TPAWSAETKKEIC---T-THGSACAFCLLLGRRLHGGKEDVNEDAPGS---CRKPVGFGNLS-LP---
FQPTKRQIQ--DV
```

SEQ ID NO: 628

```
HvsCas7-11  ----MKSIPITLTFL-EPYRILPWAEKGKRDKKE-YLRGANYVRLHKDKN---GK--
FKPYITGTLIRSAVLSAIEMLLDITNGEWNGKECCLAKF-----HTEGEKPS-FLRKKP----IYIRAEKDEIC-
--T-SRETACPLCLILGRFDKAEKKEKDKE--------KFDVHFSNLN-LY---SSKEFSTIE--EL
```

SEQ ID NO: 629

```
HsmCas7-11  ----MTKIPISLTFL-EPFRLVDWVSESERDKSE--
FLRGLSFARWHRIKNQREDENQGRPYITGTLLRSAVIKAAEELIFLNGGKWQSEECCNGQF--
KGSKAKYRKVE-CPRRRHRATLKW----TDNTC---S-DYHNACPFCLLLGCLKPNSKE-------------
NSDIHFSNLS-LP---NKQIFKNPP--EI
```

SEQ ID NO: 630

```
FmCas7-11  ----MPRFQLSLTFFDEPFRLIEWTDKSNRNSANTQWMRGQGFARWHKITL---EK--
GPPFVTGTAVRSKIIREVEALLSRNKGTWNGIPCCSGFF-----DTKGPSPT-HLRYRP--TLEWEY--
GKTVC---T-SEADVCPLCLLLGRFDQAGKKSDTPCQST-----DYHVHWENLS--A---GVAQYR-LE--DI
```

SEQ ID NO: 631

```
DpbaCas7-11  ---------------F-E----------------------SYARWCKSNS---GL--
WKPYIPGTLLRSAVLESVEYLLAL-IGSKNKVEICPGLY---TQSENNPDTK-YLRRRP--WYELHA--
QKEIC---K-TRDTACPLCLLMRTKLDNDGDGETEK----------NVKFGNL-------YPTSPLEPL--QK
```

Domains

```
...........................................................
...........................................................
.........................................
```

SECTION 2 (SEQ ID NOS 611-631, continued from section above)

D177 atypical G-rich loop

```
WmCas7x3  -----------------------------------------------------------
----------------------------------------------------------------
---------------------------
```

```
SER16298.1  -----------------------------------------------------------
----------------------------------------------------------------
---------------------------
```

```
GwCas7x3  -----------------------------------------------------------
----------------------------------------------------------------
---------------------------
```

```
PID64649.1  -----------------------------------------------------------
----------------------------------------------------------------
---------------------------
```

TABLE 15-continued shows sequence alignments of cas nucleases.

```
WP_031436019.1  ------------------------------------------------------------
                ------------------------------------------------------------
                ---------------------------------

HEB50754.1      ------------------------------------------------------------
                ------------------------------------------------------------
                ---------------------------------

HreCas7-11      AVSRVVNRVDPNSGKAKDFFRVWEIDHKLCPNFLGKMSISLS----
                EKLEDVKALLAVGLAQVNVLSGALCRVDIID-----------------------
                PETQKDTVHQHLIQQFVTRIQDKEKGDAADIPAFTLPPAGLSPSSNEWNDTIKSLAEKIR--
                KIKELEQGQKLRQMADVIREL-RRKTPAYLDQ----

CmaCas7-11      VQKRILNRVDQTCGKAKDFFKVCEVDHIACPTLNGIIRINDEKLSQEEISKIKQLIAVGLAQIESLAGGI
                CRIDITN-----------------------------------QNHDDLIKSFFETKPSKILQPNL---
                KESGEERFELAKLELLAEYLT-QSFDANQKEQQLRRLADAIRDL-RKYSPDYLKD----

HvmCas7-11      AIERIVNRVDPSSGKAKDYMRIWEIDPL VCSQFNGIITINLD---
                TDNAGKVKLLMAAGLAQINILAGSICRADIIS------------------
                EDHDALIKQFMAIDVREPEVSTSFPLQDDELNNAPAGCGDDEISTDQPVGHNLVDRVRISKIAESIE-
                DVFSQEQKAQQLRRMADAIRDL-RRSKPDETTLDA--

SmCas7x3        GSRRTINRVDDETGKAHDFFSIWEVDA--VREFQGEIVLAAD-L--
                PSRDQVESLLHHALGFVDRLCGARCVISIAD---------------------------------------
                QKPAEREERTV----AAGDEKATIADYDQVKGLPY----------TRLRPLADAVRNL-RQLDLAELNKPDGK oral_meta       GRLRTLNRIDRLTTKAQDFFRIYEVDQ--VRDFFGTITLAGD-L--
                PRKVDVEFLLRRGLGFVSTLCGAQCEIKVVD---------------------------------------
                LKKKQNNKEDSI----LPVSEVPFFLEPEVLAKMCQ-DVFPS----GKLRMLADVILRL-REEGPDNLT-----

DisCas7-11      GSQRVLNRVDFKSGKAHDFFKAYEVDHTRFPRFEGEITIDNK-V--S--
                AEARKLLCDSLKFTDRLCGALCVIRFDE--------------------------------------YTPAADSGKQT-
                ---ENVQAEPNANLAEKTAEQII-SILDDNKKTEYTRLLADAIRSL-RRSSKLVAG-----

DsbaCas7-11     AVRRVVNRVDY ASGKAHDFFRIFEVDHIAFPCFHGEIAFGEN-V--S--
                SQARNLLQDSLRFTDRLCGALCVIRYDG--------------------------------------DIPKCGKTAPLPETESI
                ----QNAAEETARAIVRVFHGGRKDPEQAQIDKAEQIQLLSAAVREL-GRDKKKVSA-----

SstCas7-11      GTQRTLNRVDYATGKAHDFFKVWEIDHSLLSVFQGKISIADN-I----
                GDGATKLLEDSLRFTDRLCGAICVISYDC-----------------------------------
                IENSDGKENGKTGEAAH----IMGESDAGKTDAENIANAIA-DMMGTAGEPEKLRILADAVRAL-
                RIGKNTVSQ-----

CsbCas7-11      ASGRILNRVDFDTGKAKDYFRTWEADYETYGTYTGRITLRN--------
                EHAKKLLLASLGFVDKLCGALCRIEVIK----------------------------------
                KSESPLPSDTKEQSYTKDDTV-----EVLSEDHNDELRKQAEVIV-EAFKQNDKLEKIRILADAIRTL-
                RLHGEGVIEKDE--

CjcCas7-11      ASERILNRVDYTTGKAHDYFKVWEVDDDQWWQFTGTITMHDD------
                CSKAKGLLLASLCFVDKLCGALCRIEVTG----------
                NNSQDENKEYAHPDTGIITSLNLKYQNNSTIHQDAVPLSGSAHDNDEPPVH--
                DNDSSLDNDTITLLSMKAKEIV-GAFRESGKIEKARTLADVIRAM-RLQKPDIWEK----

CbfCas7-11      CKERVLNRVDFRTGKAQDYFR VFEIDHEDWGVYTGEITITE--------
                PRVQEMLEASLKFVDTLCGALCRIEIVG-----------------------------
                SADETKRTTSSKEGCPASTTTRDCSSSEND----DTSPEDPVREDLKKIAHVIA-
                NAFQNSGNREKVHALADAIRAM-RLEESSIINT----

HvsCas7-11      APKRALNRIEQYTGKAQDYFTVYEALNKEFWTFKGRIRIKED-I----
                YDKVTDLLFSALRCVEKIAGALCRIEIDK--------------------------------------EPSQQKGFV
                K-------------RQLSKQAKEDIE-KIFQVVKDAQKLRLLSDCFRELTRMANKDELA-----

HsmCas7-11      GIRRILNRVDFTTGKAQDYFYVWEVEHSMCPKFQGTVKINED-M--
                PKYNVVKDLLISSIQFVDKLCGALCVIEI-----------------------------------------GKTKNYI
                C----QSFSSNIPEEEIKKLAQEIR-DILKGEDALDKMRVLADTVLQM-RTKGPEIVNE----

FmCas7-11       AQKRTSNRVDFFSKKAHDHYGVWEVTA--VKNLLGYIYISDA-
                ITESHQKTVISLLKAALSFTDTLCGANCKLELSD----------------------------------
                EPVDSIHSNQSASNFNPHSGAAPSQCSQSMP----PFNMDQETKELANTLCKAFT-------
                GNMRHLRTLADAVREM-RRMSPGISS-----

DpbaCas7-11     IRPRILNRMDPGTSKARDYFRVFEIENQLCSQFRGWIWLSGD-L--
                PNMELVKSLLAAGLSNVATLAGAVCRIRIVSTDNPSMKQDLTTQDLIDDFTNYYLKGDTPPANLAAS
                GKGDAFPRFSPGSGDHPDTTGVSHA----DMASSHEGTALAKDIAEKCK-
                DIL SQISASEQLRRLADIMRDL-RQDSNREIMYRQ--
```

TABLE 15-continued shows sequence alignments of cas nucleases.

Domains

..................................................................
..................................................................
.........................................................

SECTION 3 (SEQ ID NOS 611-631, continued from section above)

D429

```
WmCas7x3        ------------------------------------------------------------------
                -------------------------------MTTPSAPKSSL------PA----LHWLIRAELEVLTPLHLG----------------
                ----TGTDQRITPDAPDA-----DPY

SER16298.1      ------------------------------------------------------------------
                ----------------------------------------MTDTV------KS----GRWIITGQFQLVTPMHIG----------------
                ------TGLDEEMDKQSGESVDKKQNNS

GwCas7x3        ------------------------------------------------------------------
                ------------------------------------------MSNQ----TRWIIEGTLELITPLHIG-----------------
                ----TGLDE-------KERDENKETR

PID64649.1      ------------------------------------------------------------------
                ---------------------------MSDTQKQAIHENKWHF-----RGI----KRWEISAYLKTLSPLHIG----------------
                -------DG---GTIPVTIKDTQGKNREV

WP_031436019.1  ------------------------------------------------------------------
                ----------------------------------------MNLPTWKL-----NNE----KRWHISIVLTTATPLHIG--------
                ---------------SG--EFCEHDDVKNNDG--EPV

HEB50754.1      ------------------------------------------------------------------
                ----------------------------------MAAVQDRWTLMDQQGNEL----KRFRITAELETASSLHIG----------------
                ---------AS--ETVEHDLIKNDDG--TPV

HreCas7-11      -LPAGKPEG--------RESIWEK------------TPTGE--TLTLRQLLKSANVPGE-------
                SWRAFCEELGEQLYRLEKNLYS--HARPLPRLLGETEFYGQPARKS---DDPPMIRASYR----AFPS----
                YVWVLDGILRAETPFYFG----------------------TET-----------SEGQTS-

CmaCas7-11      -LPKGKKGG--------RTSIWNK------------KVADD--FTLRDCLKNQKIPNE-------
                LWRQFCEGLGREVYKISKNISN--RSDAKPRLLGETEYAGLPLRKE---DEKEYSPTYQN----QESLPK--
                TKWIISGELQAITPFYIG----------------------HVN-----------KTSHTR-

HvmCas7-11      -LPKGKTDK--------
                DNSVWDKPLKKDILPSPRMPASEDDDTPTLRKVLKDEINGQED------
                MWRKFCEALGNSLYDLSKKAKERKRTEALPRLLGETEIYGLPMREN---KEDEPLPSSLT----YK------
                FKWLIAGELRAETPFFFG----------------------TEV-----------QEGQTS-

SmCas7x3        FLPPGRVNK---DGRRVPHYVWDIP-----------LGKGD----TLRKRLEFLAASCEGDQA--
                -KWRNICESEGQALYEKSKKLKD--SPAAPGRHLGAAEQVRPPQPPV---SYSEESINSDL----PL------
                AEWIITGTLRAETPFAIGM--------------------DAPI-----------DDDQTSoral_meta       -LPMGSQGL---GGRL-PHHLWDVP-----------LVSKDRETQTLRSCLEKIAAQCKSEQT---
                QFRLFCQKLGSSLFRINKGVYL--APNSKISP----EPCLDPSKTI---RTKGPVPGKQK----
                HRFSLLPPFEWIITGTLKAQTPFFIP--------------------DEQG----------SHDHTS- DisCas7-11      -LPKDHDGK---D----DHYLWDIG-----------KKKKDENSVTIRQILTTSADTKELKNAG--
                KWREFCEKLGEALYLKSKDMSG--GLKITRRILGDAEFHGKPDRLE---KSRSVSIGSVL------------
                KETVVCGELVAKTPFFFG----------------------AIDE----------DAKQTD- DsbaCas7-11     -LPLNHEGK---E----DHYLWDK-----------KAGGE----TIRTILKAAAEKEAVAN----
                QWRQFCIELSEELYKEAKKAHG--GLEPARRIMGDAEFSDKSVPDT---VSHSIGISVE-------------
                KETIIMGTLKAETPFFFG----------------------IESK----------EKKQTD- SstCas7-11      -LPLDHEGK---E----NHHLWD-------------IGEGK----SIRELLLEKAESLPSD-----
                QWRKFCEDVGEILYLKSKDPTG--GLTVSQRILGDEAFWSKADRQL---NPSAVSIPVT-------------
                TETLICGKLISETPFFFG----------------------TEIE----------DAKHTN- CsbCas7-11      -LPDGKEER---DK---GHHLWDI------------KVQGT----ALRTKLKELWQSNKDI-----
                GWRKFTEMLGSNLYLIYKKETG--GVSTRFRILGDTEYYSKAHDSE---GSDLFIPVTPP----EGIET---
                KEWIIVGRLKAATPFYFGVQQPSDSIPGKEK------KSEDSLV----------INEHTS- CjcCas7-11      -LPKGINDK---------HHLWDR-----------EVNGK----KLRNILEELWRLMNKRN----
                AWRTFCEVLGNELYRCYKEKTG--GIVLRFRTLGETEYYPEPEKTEPCLISDNSIPITPL----GGV-----
                KEWIIIGRLKAETPFYFGVQSSFDSTQDDLDLVPDIVNTEKLE----------ANEQTS- CbfCas7-11      -LPKGKSEKTTEQIEVNKHYLWDEI-----------PVNDT----
                SVRHILIEQWRRWQSKKDD-PEWWKFCDFLGECLYKEYKKLTS--
```

TABLE 15-continued shows sequence alignments of cas nucleases.

```
              GIQSRARVMGETEYYGALGMPD---KVIPLLKSDKT-----------KEWILVGSLKAETPFFFGLET-----------
              --------EQTE-----------EVEHTS-

HvsCas7-11    -LPLGPEDD---------GHYLWDKI----------KVEGK----TLRIFLRNCFSQYKD------
              NWLCFCDEASKKGYQKYREKRH--KLTDRELPTATPKHFAEKKDPQ---ISPIYIDKDDK----V-------
              YEWIIVGRLIAQTPFHFG-------------------------------------DEEKAE-

HsmCas7-11    -LPRGIEKK---G----GHWLWDKL-----------R---------LRKKFKEIANNYKD------
              SWQELCEKLGNELYISYKELTG--GIAVKKRIIGETEYRKIPEQEI---SFLPSKAGYS-------------
              YEWIILGKLISENPFFFG---------------------KETK-----------TEEQID-

FmCas7-11     -LPRGRLNK---EGEITAHYLWDE-------------RIDEK----
              TIRQVLEDTIELSPARSIIYKNWISFCNQLGQKLYERAKD-ND--PILERKRPLGEAAFSKVPTSSH---
              APRHDMNSRVK----GGFT----REWIIVGTLRALTPFYMG--------------------TGSQ----------AGKQTS-

DpbaCas7-11   -VAEENHEK-------ASLLYKK------------TKKGD----SIAALIAGKTEGMDA-----
              ETWRRLCEFLGQTFYGEAKEAGL--VETPVPRILGESERYSLQKKPT---VRTDLAAELVP----D-------
              IEFIIKGNLIAETPFFFG--------------------TDIA-----------TETHTD-
```

Domains

```
................................................................
................................................................
.................................................
```

SECTION 4 (SEQ ID NOS 611-631, continued from section above)

*
G-rich loop

```
WmCas7x3      WQADIALDADGRPYLPGASLKGALKALARRRQVDAPCL-
              PLFGDLNRGGAPHPDCIPPRRTRAGLAEFRDALQSHAT--QAD--GPDT---------
              AQPRIAIDRITGSVVDKKLFHTQTVPVGTRFSVEI--ILRRADQ--NLAAQLVALLQHGPT-----
              DPDFRLGAHANLGFGRVGL-YGNIDTRRFGPQQAQ-H

SER16298.1    WIQAIALDLNKKPYIPGASIKGALKALARRYYCASNL--NIFGDTI--
              DTKDGDNKRKSVTVAGQAEFLNA-WYAAD--QED--KPFD---------
              TITRVAIDRVTGTAEDRKLFNTRRVNPGVCFNYKI--IIQNACE--TEIQYLLDLLRKAAK-----
              DPSFSLGAGANQSQGKVRC-LSSC-VRYFGKQEMH-D

GwCas7x3      WLEAVALDHKGQPYIPGASLKGALRALAKRHD---------FRNLF--DNKEVDGD-----
              FVRQAEFLSA-WCVPD--TDK--GRL----------IQPRVAIDRVTGTAQDKKLFQTRLITPGTRFAMKI--
              VVQNAVE--NEIADLLGLLNLLPD-----DPQFSLGAYANQGQGRVQW-FGKIQTRCFGINEAK-A

PID64649.1    EVNSVITGKAALPIIPGSTIKGRLRHYFSKHFSDKALLNKVFGEES--DATDDDQG-----
              RGGLAEFHDAKWNPEK--
              NRNLQGRYPYWNNTRKTYIEVSTAINRHTGAAKDKSLHHTECVPPGTVFEIKITGSMDDRCA--
              ALVVAALEAIQTTGS-----RIFL--GAEDANGNGRIGL-TGKITVKQMDQAHII-Q

WP_031436019.1 KINACIKGSKGRPIIPGSTIKGKLYEWLKTRNTEENLLEKLFGKGH--
              NSVSQDQG-----RGGKAEFHDAEIIEPL--TGS--
              QPWPYWREEHQAFIAASTAIDRHKQVALQQSLHYMETVPAGIRFKFTFTGVMRDEEA--
              ALLIAALDSFDKNON-----QPCF--GVDRANAYGRMEL-HGHLHVKVMGATEIS-S

HEB50754.1    QINALITGAGGLPIIPGSTIKGRFLARLRERGVDSALLETLFGKGH--DRETEDQG-----
              RGGRAEFHDAPLCHRL--SGA--
              RHFPYWRPERQIWVKAQTAVDRHRGTALRRSLRYTEMVPPGVRFRLTITGCMTDAEA--
              DVLFALLEDLGDPRQ-----ACSF--GGAGADGNGTMRL-FGRPEVYCLDRSGIL-G

HreCas7-11    --QAIILCPDGSYRLPRSLLRGVIRRDLRAIL-GTGCNVSLGKVRP--CSCPVCE------
              IMRRITVQQG---VSS--YRE--PAE----------VRQRIRSNPHTGTVEEGALFDLETGPQGMTFPFRL----
              YFRTRSPYIDRALWLTINHWQE-----GKAI-FGGDIGVGMGRFRL-E-NLQIRSADLVSRR-D

CmaCas7-11    --STIFLNMNGQFCIPRSTLRGALRRDLRLVF-GDSCNTPVGS-RV--CYCQVCQ------
              IMRCIKFEDA---LSD--VDS--PPE----------VRHRIRLNCHTGVVEEGALFDMETGFQGMIFPFRL----
              YYESKNEIMSQHLYEVLNNWTN-----GQAF-FGGEAGTGFGRFKL-L-NNEVFLWEIDGEEED

HvmCas7-11    --ATILLNRDGYFRLPRSVIRGALRRDLRLVMGNDGCNMPIGG-QM--CECGVCR----
              --VMRHIVIEDG---LSD--CKI--PPE----------VRHRIRLNCHTGTVEEGALFDMETGYQGMTFPFRL----
              YCETENSDLDSYLWEVLNNWQN-----GQSL-FGGDTGTGFGRFEL-T-EPKVFLWNFSKKE-K

SmCas7x3      --SRTLVDRDGRYRLPRSTLRGILRRDLSLASGDQGCQVRLGPERP--CTCPVCL------
              ILRQVVIADT---VSE--TTV--PAD----------IRQRIRRNPITGTAADGGLFDTERGPKGAGFPFSL----
              RYRGH-APMPKALRTVLQWWSA-----GKCF-AGSDGGVGCGRFAL-D-NLEVYRWDLGTFA-F
```

TABLE 15-continued shows sequence alignments of cas nucleases.

```
oral_meta  --RKILLTRDFYYRLPRSLLRGIIRRDLHEATDKGGCRVELAPDVP--CTCQVCR------
LLGRMLLADT---TST--TKV--APD----------MRHRVGVDRSCGIVRDGALFDTEYGIEGVCFPLEI----
RYRGN-KDLEGPIRQLLSWWQQ-----GLLF-LGGDFGIGKGRFRL-E-NMKIHRWDLRDES-A DisCas7-11 --LQVLLTPDNKYRLPRSAVRGILRRDLQTYF-DSPCNAELGG-RP--CMCKTCR------
IMRGITVMDA---RSE--YNA--PPE----------IRHRTRINPFTGTVAEGALFNMEVAPEGIVFPFQL----
RYRGSEDGLPDALKTVLKWWAE-----GQAF-MSGAASTGKGRFRM-E-NAKYETLDLSDEN-Q DsbaCas7-11 --LMLLLDGQNHYRIPRSALRGILRRDIRSVL-GTGCNAEVGG-RP--CLCPVCR------
IMKNITVMDT---RSS--TDT--LPE----------VRPRIRLNPFTGSVQEKALFNMEMGTEGIEFPFVL----
SYRGK-KTLPKELRNVLNWWTE-----GKAF-LGGAASTGKSIFQL-S-DIHAFSSDLSDET-A SstCas7-11 --LKVLLDRQNRYRLPRSAIRGVLRRDLRTAFGGKGCNVELGG-RP--CLCDVCR------
IMRGITMDA---RSE--YAE--PPE----------IRHRIRLNPYTGTVAEGALFDMELGPQGLSFDFIL----
RYRGKGKSIPKALRNVLKWWTK-----GQAF-LSGAASTGKGIFRL-D-DLKYISFDLSDKD-K CsbCas7-11 --FNILLDKENRYRIPRSALRGALRRDLRTAF-GSGCNVSLGGQIL--CNCKVCI------
EMRRITLKDS---VSD--FSE--PPE----------IRYRIAKNPGTATVEDGSLFDIEVGPEGLTFPFVL----
RYRGH--KFPEQLSSVIRYWEENDKNGMAW-LGGLDSTGKGRFAL-K-DIKIFEWDLNQ---K CjcCas7-11 --FRILMDKKGRYRIPRSLIRGVLRRDLRTAFGGSGCIVELGRMIP--CDCKVCA------
IMRKITVMDS---RSE--NIE--LPD----------IRYRIRLNPYTATVDEGALFDMEIGPEGITFPFVF----
RYRGE-DALPRELWSVIRYWMD-----GMAW-LGGSGSTGKGRFAL-I-DIKVFEWDLCNEE-G CbfCas7-11 --LRLVMDKKGRFRIPRSVLRGALRRDMRIAF-DSGCDVKLGSPLP--CDCSVCQ------
VMRSITIKDS---RSE--AGK--LPQ----------IRHRIRLNPFSGTVDEGALFDIEVAPEGVIFPFVM----
RYRGE--EFPPALLSVIRYWQD-----GKAW-LGGEGATGKGRFALAK-DLKMYEWKLEDK--S HvsCas7-11 --GAILLTPDNRFRLPRTALRGILRRDLKLAG-ASACEVEVGRSEP--CPCDVCK------
IMRRVTLLDT---VSEDLRDF--LPE----------LRKRIRINPQSGTVAEGALFDTEVGPEGLSFPFVL----
RYKCE--KLPDSLTTVLCWWQE-----GLAF-LSGESATGKGRFRL-E-INGAFVWDLQK---G HsmCas7-11 --MQILLTKDGRYRLPRSVLRGALRRDLRLVI-GSGCDVELGSKRP--CPCPVCR------
IMRRVTLKDA---RSD--YCK--PPE----------VRKRIRINPLTGTVQKGALFTMEVAPEGISFPFQL----
RFRGE-DKFHDALQNVLVWWKE-----GKLF-LGGGASTGKGRFKL-E-IEHVLKWDLKN---N FmCas7-11 --MPTLQDSNDHFRLPRTALRGALRRDINQASDGMGCVVELGPHNL--CSCPVCQ----
--VLRQIRLLDT---KSK--FSM--PPA----------IRQKICKNPVLSIVNEGSLFDVELGIEGETFPFVM----
RYRGG-AKIPDTIITVLSWWKN-----ERLF-IGGESGTGRGRFVL-E-CPRIFCWDVEK---G DpbaCas7-11 --LPILLTSDRHFRIPRSVLRGILRRDLRLVT-GSGCSVKLGRSEP--CACDVCQ------
IMRSLTMRDC---VSS--CKV--PPE----------IRHRIRLNPVTETVEEGALFDMEIGPQGISFPFVL----
RSRGVNSSFSTRLKNVLTWWSE-----GKIF-MGGDKGTGKGRFTL-A-ELEAYYFRLTTKRIG
```

Domains

```
.................................................
.................................................
.................................................
```

SECTION 5 (SEQ ID NOS 611-631, continued from section above)

D654

```
WmCas7x3 WF-----AAAQTQADARW-TDFAEA---VT----------------LTAPAPAPAQP---------------
APHRLALP---------------------------LSLTFHTPFLVKQPEHKH--R----KPQDNAPDGTPR----QRGD-----
-----RA----LLPGASLRGRLRSQAERILRTLGCK

SER16298.1 WF-----RAIQNGKQEHW-QIFAKP---SN-----------------IKYADLERPDI----------------
IANSLNLP---------------------------LTLDFHTPFLVKASKKK--------DEAKNEADAKPR---TNHQG------
----QV----ILPASSLRGRLRAQAEKILRTMGQD

GwCas7x3 WY-----EEIRKDESKCW-TAFAKP---KN-----------------VSTP---PTPA---------------
KEAQLTLP---------------------------LNLAFHTPFLVKQAGIK-----------ADDADAVPR---
RTHDD--------
--KI----VLPASSLRGRLRTQSERILRTLGCE

PID64649.1 WL-----Q-----KDST--TCVASF---SN-----------------VKAENETQVKQ--------------
MVQRHIAPKLNSVVSAAG-----------------PSYDITLHFDGPFVVNDSDKC-------KAEDTPDIYPL---
EEKNG---------VP----AFPVRSFRGAIRSQAERIIRTIGGQ

WP_031436019.1 WL-----NSFSE-NDKK--MAMESA---RN-----------------LEQQEINTLIE---------------
QGNALFKA------SCDE-----------------VKLGLTLKFKGPFLVNDPYAVKILS----SNENAKTDHYPL---
LDKNR----------NP----YLPVSSFRGVLRSQAERIIRTLGGK
```

TABLE 15-continued shows sequence alignments of cas nucleases.

```
HEB50754.1    WL-----ASFEKGGNGG--MAMTAA---AL-----------------LQADTVQRRAD----------------
KVRQAWQP------PDVG------------------PRLHVELRFSGPFLVNDPSRN---T----PDITQAPDMVPL---
VDEDG----------NP----MLPASSFRGALRAQAERIIRTLGGR

HreCas7-11    FS-----LYLRA---RGL-KGLSR----EE-----------------VTRIGLNEEQWEAVMA----DD-----
PGTHYNPF------P--W-----------------EKISYTLLIHSPLISNDPIAAM--L----D--
HDNKDAVMVQKTVLFVDESGN-----YSQMPHHFLKGSGIRGACRFLLGRK-------

CmaCas7-11    YL-----QYLFS---RGY-KGIE-----TD-----------------EIKKVADPIKWKTLF-----TK-----
LEIPPEKI------P--L-----------------TQLNYTLTIDSPLISRDPIAAM--L----D--
NRNPDAVMVKKTILVYEQDSSTHKNVPKEVPKYFIKSETIRGLLRSIISRT-------

HvmCas7-11    HE-----AYLLN---RGF-KGQMPV---QD-----------------VKTKSFKTKTWFQIH-----RE----
-LDISPKKL------P--W-----------------YSTDYRFNVTSPLISRDPIGAM--L-----D--
PRNTDAIMVRKTVFCPDPNA---KNRPAPATVYMIKGESIRGILRSIVVR--------

SmCas7x3      RQ-----AYSEN---NGL-RSPEEEFDLAV-----------------IHELAEGLAKEDGQK------------
ILKGTEPF------TC-W-----------------QERSWQFSFTGPLLQGDPLAAL--N------
SDTADIISFRRTVVDNGEVL------REP----VLRGEGLRGLLRTAVGRV------- oral_meta     RA-----DYVQK---CGLRRGVGDDTAINL-----------------EKDLSLNLPE--------------------
SGY------P--W------------------KKHAWKLSFQVPLLTADPIMAQ--T-------
RHEEDSVYFQKRIFTSDGRVV-----LVP----ALRGEGLRGLLRTAVSRA-------

DisCas7-11    RN-----DYLKN---WGW-RDEKGL---EE----------------LKKRLNSGLP----------------
EPGNYRDP------K--W------------------HEINVSIEMASPFINGDPIRAA--V----D--
KRGTDVVTFVKYKAEGEEAK------PVC----AYKAESFRGVIRSAVARI-------

DsbaCas7-11   RE-----SYLSN---HGW-RGIMEN---SI-----------------VHESPLEGGAGGCSF------------
GLSDLPKL------G--WHAEDLKLSDIEKYKPFHRQKISVKITLNSPFLNGDPVRAL--T-------
EDVADIVSFKKYTQGGEK--------IIY----AYKSESFRGVVRTALGLR-------

SstCas7-11    RK-----DYLDN---YGW-RNRIEA---LS-----------------LEKMPLD-------------------
RMNDYAEP------L--W------------------QKVSVEIEIGSPFLNGDPIRAL--I----E--
KDGSDIVSFRKYADDSGK--------EVY----AYKAESFRGVVRAALARQ-------

CsbCas7-11    IN-----EYIKE---RGM-RGKEKELLEMG----------------ESSLPDGLIPYKFFEEREC-LF---
--PYKENLKP------Q--W------------------SEVQYTIEVGSPLLTADTISAL--T----E--
PGNRDAIAYKKRVYNDGNNA-------IEPEPRFAVKSETHRGIFRTAVGRR-------

CjcCas7-11    LK-----AYICS---RGL-
RGIEKEVLLENKTIAEITNLFKTEEVKFFESYSKHIKQLCHECIINQISFLWGLRSYYEYLGP------L--W-
----------------TEVKYEIKIASPLLSSDTISAL--L-----N--KDNIDCIAYEKRKWENGGIK------FVP----
TIKGETIRGIVRMAVGKR-------

CbfCas7-11    LH-----AYIDT---YGH-RGNEHAIGTGQ-----------------
GIDGFRSGSLSDLLSDISKESFRDPLASYHNYLDK------R--W-----------------
IKVGYQITIGAPLLSADPIGAL--L----D--PNNVDAIVFEKMKLDGDQVK------YLP----
AIKGETIRGIVRTALGKR-
HvsCas7-11    LF-----NYIKN---HGF-RGEERLFLEGN----------------EAELEKMGIQINTELLQPEMIK--
---KEKNFTDF------P--Y------------------DLIKYQLNISSPLLLNDPIRAI--ALYEGE--
GKAPDAVFFKKYVFENGKIE------EKP----CFKAESIRGIFRTAVGRI-------

HsmCas7-11    FH-----SYLQY---KGL-RDKGDFNSIKE----------------IEGLKVETEEFKVK--------------
---KPF------P--W------------------SCVEYTIFIESPFVSGDPVEAV--L----D--SSNTDLVTFKKYKLEESK-----
---EVF----AIKGESIRGVFRTAVGKN-------

FmCas7-11     QN-----DYIQY---HGF-RNKEDEL--LS-----------------VYSTVSGLAEKNDV-------------
NLNNARDF------S--F------------------DKICWEVQFDGPVLTGDPLAAL--F-------
HGNTDSVFYKKPILKSGEKE------PSY--QWAIKSDTVRGLIRSAFGKR-------

DpbaCas7-11   KNVWVIGNYLKS---QGW-RG-------AE-----------------LETHFDSLKEWKSL------SF----
-SDSDVKVF------T--W------------------HKITWKVSFEGPVLTNDPIAAD--I-------RNESDAVFYQKSV--
AGEKG-------PVY----ALKGEGLRGIVSSSLCKK-------
```

Domains

.................................................................
.................................................................
.............................................

SECTION 6 (SEQ ID NOS 611-631, continued from section above)

\*
```
WmCas7x3      VAQG---------HAVPPVKNNTCP-DPATL-----LFGTAGWRGLLRTDD--------------------
-------CTGTA----------------------------------------------------------
--PAT----------------------------LVD
```

TABLE 15-continued shows sequence alignments of cas nucleases.

```
SER16298.1      IPQG--------HAAPAYDGIAHR-DLISL-----
LFGTAGWKGIVCASDLIHSIPEYALQFNGVRETISDLSDTVKSCIIVDLVKTSTAAEKTEEQLHIRIVDS
AGSLIVHKSENSSWANDTFRDASVKDNFKARLKEIADPQDLSDALRADIKKRAFQLAT-----------------
------------------LTR

GwCas7x3        TPQG---------HTAPAYRKGQPHDDLAVL-----LFGAAGWRGIVQTSD---------------------
------CIVED-----------------------------------------------------------------
-KSIK-----------------------------TRR

PID64649.1      CCDG---------SINNTCK------NPKNLCIACEMFGSTGWKTSIEMDPFL---------------------
----CVDRE-------------------------------------------------------------------
LKP------------------------------FII

WP_031436019.1  CCS-----------TDDPCKPIFDKGDLSKLCLACQIFGASGWKTVINIHDFK----------------
----------AINKS-------------------------------------------------------------
--------K-----------------------------KTK

HEB50754.1      CCD----------TSSPCRPLGSSDKVGELCLACQVFGAPGWGTTLHIQGFT------------------
---------CTSV----------------------------------------------------------------
----FRR.-------------------------------EQE

HreCas7-11      -DAPNE------NGLTYFE--ADHEE--CDCLLCSLFGSKHYQGKLRFEDAE------------------
---------LQDEV----------------------------------------------------------------
---EA----------------------------------IK

CmaCas7-11      -EIKLE----DGKKERIFN--LDHED--CDCLQCRLFGNVHQQGILRFEDAE------------------
---------ITNKN----------------------------------------------------------------
----VS---------------------------------DCC

HvmCas7-11      -------------NEELYD--TDHED--CDCILCRLFGSIHQQGSLRFEDAE----------------------
--VQNSV----------------------------------------------------------------------SD--
---------------------------------KK

SmCas7x3        -------------AGDDLLT--RSHQD--CKCEICQLFGSEHRAGILRFEDLP-----------------------
-PVSPT----------------------------------------------------------------------TV---
----------------------------ADKR oral_meta       -------------YGISLIN--DEHED--CDCPLCKIFGNEHHAGMLRFDDMV----------------------
-PVGTW----------------------------------------------------------------------ND-
----------------------------KK DisCas7-11      -HME-------DGVPLTE--LTHSD--CECLLCQIFGSEYEAGKIRFEDLV------------------------
----FESDP--------------------------------------------------------------------
EP--------------------------------VT DsbaCas7-11     -NQGNDDIT-GKKNVPLIA--LTHQD--CECMLCRFFGSEYEAGRLYFEDLT--------------
---------------FESEP----------------------------------------------------------
----------EP-----------------------------RR SstCas7-11      -HFDKEGKPLDKEGKPLLT--LIHQD--CECLICRLFGSEHETGRLRFEDLL----------------
---------FDPQP----------------------------------------------------------------
-----EP---------------------------MI CsbCas7-11      ------------TGDLG-K--EDHED--CTCDMCIIFGNEHESSKIRFEDLE------------------------
LINGN-----------------------------------------------------------------------EF---
----------------------------EKLEKH CjcCas7-11      -------------SGDLG-M--DDHED--CSCTLCTIFGNEHEAGKLRFEDLE------------------------
-VVEEK-----------------------------------------------------------------------
LPSEQNSDSNKIPFGPVQDGDGNREKECVTAVKSYKKKL CbfCas7-11      ------------NNLLA-K--NDHDD--CTCSLCAIFGNENETGKIRFEDLE------------------------
-VYDKD------------------------------------------------------------------------IA--
-----------------------------KK HvsCas7-11      ------------KNVLT----KNHED--CICVLCHLFGNVHETGRLKFEDLK------------------------
--IVSGQ-----------------------------------------------------------------------EE--
-----------------------------KF HsmCas7-11      ------------EGKLTTE--NEHED--CTCILCRLFGNEHETGKVRFEDLE------------------------
---LINDS-----------------------------------------------------------------------AP--
-----------------------------KR FmCas7-11       ------------DALLI----KSHED--CDCLLCEAFGSKHHEGKLRFEDLT------------------------
PKSDE-------------------------------------------------------------------------IK----
----------------------------TYR
```

TABLE 15-continued shows sequence alignments of cas nucleases.

```
DpbaCas7-11 ------------KNLSS----NLHED--CECLRCKIFGSKHQEGNIRFEDMT-----------------------
-VSQES--------------------------------------------------------------------EV----
---------------------------REKL
```

Domains

```
..................................................................
..................................................................
...........................................................
```

SECTION 7 (SEQ ID NOS 611-631, continued from section above)

```
D745 D758 G-rich loop

WmCas7x3 HDMLAIDRFTGGGKDGAKFKLRYA-----ECPTLEGQLSLDLSRLRSARLD------
GANAADTPWIALGLLTLVLRDLAEGDIPFGHGSAKGYGRCRAQGLPDRWRQALEAHFGPNADARA
LAALRAWCRTHATAAL--DAPCSLAGSAPTPAAAAPS--GQAAPAD---AFHN--PYHFI-P-F-
SQPDIDRWLSPDA

SER16298.1 HEMVAIDRFTGGGKEGAKFNVDYI-----ECPTLTGAIYLDLHRLKQAQLK------
NDEDALKP--
ALGLISLLLRDLAEGDIAFGFGANKGYGQCREHAVLDNWEERLKKIGAGLTIDGALQALRDTVALEP
PAEF---PPEIEKTTDDNQPEAPDF--NLKPASN---GFHN--PYHFI-P-L-NNPKIGDWPEAKA

GwCas7x3 HEMLAIDRFTGGGKDGAKFNVDYV-----ECPTLAGKLSLDLARLKNAKLK------
GGKDALLP--
ALGLMTLMLRDLAEGDIPFGYGISKGYGQCRASSALGDWAELLKQHLGADSADTTVQALREYLGN
PKGQELKLDPPSADATQAGVPAQQNAAKTQAQGAQE---KFHN--PYHFI-P-L-SKPDISQWPEPQK

PID64649.1 QEFVAIDRFHGGGKDEAKFNAAHY-----QAPVFKGKVRVS-QRVGN-DIS------WRK--
--------GLLALIFRDLKEGDIYFGFGTNKGYGAVKKAEINPDGN-------
ASDFSESDIEAFINKCREKKGLYNC--NPIKKPGKTKVSKNLPPAIVPLDRTDS---KFYN--PYHFI-P-V-
KKPNTSSWAEKTA

WP_031436019.1 QDFVAIDRFHGGGKDGAKFDATHF-----ERPEFEGAISFS-PRMANNDLD------
WGK---------GLLALVLRDMQEGDMTFGYGANKGYGGLESASITGIEQ-----------
ITSDIQAFRDKCVASPQTWLCDEAVKPANQQD----KIPPA--GIQVANS---GFHN--PYQFI-P-S-
KEPDTGHWLPVLG

HEB50754.1 QTFVAIDRFHGGCKEGALYTIRHA-----ESPRFEGHLVID-PRMPA----------WGR-------
--GLLALVFRDLREGDITFGLGAGKGYGVVDAAVVQDMAE-----------
LEPYVEAFREQCRQHQGMADCHSAPSPQPLRDHDLAEIPPA---EEAPGE---TFLN--PYHFV-P-I-
REPDTGSWLARDE

HreCas7-11 CDHVAIDRFHGGTVHRMKYDDYPLPGSPNRPLRIKGNIWVK------RDLS-----DTEK--
--------EAVKDVLTELRDGLIPLGANGGAGYGRIQRLMI-DDGPGW-----------------
LALPERKEDERPQPSFSPVS--------LGP-VHVNLKSGSDTADVYYYHPHYFL-E-PPSQTV---------

CmaCas7-11 IDHVAIDRFTGGGVEKMKFNDYPLSASPKNCLNLKGSIWIT------SALK-----DSEK---
-------EALSKALSELKYGYASLGGLSAIGYGRVKELTLEEN---------------------
DIIQLTEITESNLNSQSRLS--------LKP-DVKKELSNN---HFYY--PHYFI-K-PAPKEV--------

HvmCas7-11 MDHVAIDRFTGGGVDQMKFDDYPLPGCPAQPLILEGKFWVK------DDID-----
DESK---------SALEKAFADFRDGLVSLGGLGAIGYGQIGDFELIGGSADW------------------
LNLPKPEENRTDVPCGDRSA--------QGP-EIKISLDAD---KIYH--PHFFL-K-PSDKNV---------

SmCas7x3 LDHVAIDRFDQSVVE--KYDDRPLVGSPKQPLVFKGCFWVQ------TSGMT----HQLT--
--------ELLAQAWRDIAAGHYPVGGKGGIGYGWINSLVVDGEK--------------------
ITCRPDGDSISLTTVTGDIP--------PRP-ALTPPAG-----AIYY--PHYFLPPNP-EHKP--------- oral_meta IDHVSCSRFDASVVN--KFDDRSLVGSPDSPLHFEGTFWLH------RDFQ-------ND---------
VEIKTALQDFADGLYSIGGKGGIGYGWLFDMEIPRSLRKLNSGFREA----------
SSIQDALLDSAKEIPLSAPLT--------FTP-VKG---------AVYN--PYYYL-PFP-AEKP---------

DisCas7-11 FDHVAIDRFTGGAADKKKFDDSPLPGSPARPLMLKGSFWIR------RDVLED---EEYC-
---------KALGKALADVNNGLYPLGGKSAIGYGQVKSLGIKGDDKRI------------------
SRLMNPAFDETDVAVPEKPK--------TDA-EVRIEAE-----KVYY--PHYFV-E-P-HKKV---------

DsbaCas7-11 FDHVAIDRFTGGAVNQKKFDDRSLVPGKEGFMTLIGCFWMR------KDKELS---
RNEI---------EELGKAFADIRDGLYPLGAKGSMGYGQVAELSIVDDEDSDDENNPAK----------
LLAESMKNASPSLGTPTSLKK--------KDA-GLSLRFDEN---ADYY--PYYFL-E-P-EKSV---------

SstCas7-11 FDHVAIDRFTGGAVDKKKFDDCSLPGTPGHPLTLKGCFWIR------
KELEKPDEDKSER---------EALSKALADIHNGLYPLGGKGAIGYGQVMNLKIKGAGD--------------------
VIKAALQSESSRMSASEPEH--------KKP-DSGLKLSFDDKKAVYY--PHYFL-K-PAAEEV---------
```

TABLE 15-continued shows sequence alignments of cas nucleases.

```
CsbCas7-11  IDHVAIDRFTGGALDKAKFDTYPLAGSPKKPLKLKGRFWIK------KGFS-----GDHK---
------LLITTALSDIRDGLYPLGSKGGVGYGWVAGISIDDNVPDDFKEMINK---------
TEMPLPEEVEESNNGPINNDY--------VHP-GHQSPKQDHKNKNIYY--PHYFL-D-S-GSKV---------

CjcCas7-11  IDHVAIDRFHGGAEDKMKFNTLPLAGSFEKPIILKGRFWIK------KDIV-----KDYK-----
----KKIEDAMVDIRDGLYPIGGKTGIGYGWVTDLTILNPQSGFQ-----------------
IPVKKDISPEPGTYSTYPSH--------STP-SLNKG-------HIYY--PHYFL-A-P-ANTV---------

CbfCas7-11  IDHVAIDRFTGGARDQMKFDTLPLIGSPERPLRLKGLFWMR------RDVS-----PDEK---
------ARILLAFLEIREGLYPIGGKTGSGYGWVSDLEFDGDAPEAFKEMNSK---------
RGKQASFKEKISFRYPSGAPK--------HIQ-NLKAT-------SFYY--PHYFL-E-P-GSKV---------

HvsCas7-11  FDHVAIDRFLGGAKEKYKFDDKPIIGAPDTPIVLEGKIWVK------KDIN-----DEAK----
-----ETLSQAFSDINTGIYYLGANGSIGYGWIEEVKA-LKAPSWLKIK-------------
EKPNFEKDTSLNISAIMNEF--------KKD-IQTLNLD-----KTYL--PYGFL-K-L-LEKV---------

HsmCas7-11  LDHVAIDRFTGGAKEQAKFDDSPLIGSPDSPLEFTGIVWVR------DDID-----EEEK----
-----KALKSAFLDIKSGYYPLGGKKGVGYGWVSNLKI-ESGPEWLRLEVQE----------
KSSQENVLSPVILSEVMDIEF--------NPP-KIDEN-------GVYF--PYAFL-R-P-LNEV---------

FmCas7-11   MDHVAIDRISGGAVDQCKYDDEPLVGTSKHPLVFKGMFWIN------RDSS-----
VEMQ---------RALIAAFKEIRDGLYPLGSNGGTGYGWISHLAI-TNGPDWLNLEEVP---------
LPQPTADIPVEECTAEPYPKF--------QKP-DLDQN-------AVYY--PHYFL-Q-P-GKPA---------

DpbaCas7-11 FDHVSIDRFTGGAANKLKFDDKPLVG---NPLVFQGVFWVH------QSIGNN---EKTQ-
---------EALSDAFKDVRDGLYPVGAKGSIGYGWIKGIEV-VEGPDWLK---------------
DALSAEKTVEAGIASEESEY--------KLP-DLPWISLLPKGRAIYN--PHYFL-GIP-KVTP---------
```

Domains

```
....................................................
....................................................
...............................................
```

SECTION 8 (SEQ ID NOS 611-631, continued from section above)

E959

```
WmCas7x3    H---RKTGGH-SRYRG--------------LSGRLVCALTTVTPLFVGAAA-RTP-ASDQHPK---
-P----VAGFALQNQPAIPATSLRGLLSSLFESISGSNLRVLHPT-PYSIRKTTKE--------------ALSA--I-
----------G--------------------------

SER16298.1  ETLKANREGH-DQYHTGK------------FSGRIVCSLTTQTPLFIGAET-KPS-TSDREPS---
--------E----ARPFKLNGKHAIPATSLRGMLSSLFESVSNSNFRVLHPE-HYSVRKSLDDYV-------------
ALSA--M----------------G--------------------------

GwCas7x3    L--TEKGHSH-DRYAS--------------LSGRIVCRLTTQTPLFIGSEQ-TTP-TNPQAPK-------
---S----LHPFKLNNGLAIPATSLRGMISSLFESVSNSNFRVLDEK-TYSMRKTMQQ---------------SLSA--
M----------------G--------------------------

PID64649.1  FGTADSPHSH-GFYRKQTNE------QQPLYSGRLICMLTSETPFFIGAQA-ESD---
PTENE----------NQASLRHPYQLDGEPAIPSTSLRGLISTMTEAAANCAMRVLDSE-IISYRKPMNPSH----
----------ILSA--L----------------G--------------------------

WP_031436019.1 L-NADSHHSH-AFYRDQTDN------GEKL YHGRLICCLNTETPIFIGADK-KKD-
TEPAEIN----------N-------YRLNGELAIPATSLRGMISSLAEAASNSAMRVLDNG-LLSYRKTADD--------
--------ALRK--V----------------G--------------------------

HEB50754.1  L-DSSCCHSH-GFYRQQVDD--------RPLYHGRLTCLLETETPLFIGATG-DSS-V-
PSRIE----------N-------YRLGNRIAIPAASLRGMLSSLAEAASNSAMRVLHQG-ILSYRKKAKN-------------
--ALRE--I----------------G--------------------------

HreCas7-11  S-RELDIISHARTRDS---G------GEALLTGRILCRLITRGPIFIPDTN-NDNAFGLEGGI-G-
-----HKN----YRFFRINDELAIPGSELRGMVSSVYEALTNSCFRIMEEGRYLSRRMGADEFK--------------
-DFHP----------------G--------------------------

CmaCas7-11  V-RESRLISHVQGHDT---E------
GEFLLTGKIKCRLQTLGPLFIANNDKGDDYFELQHNNPG------HLN----
YAFFRINDHIAIPGASIRGMISSVFETLTHSCFRVMDDKKYLTRRVIPESETTQKRKSGRYQVEESDPD
LFP----------------G--------------------------

HvmCas7-11  Y-RERELVSHAKKKGP---D------
GKSLFTGKITCRLSTEGPVFIPDTDLGEDYFEMQASHKK------HKN----
YGFFRINGNVAIPGSSIRGMISSVFEALTNSCFRVFDQERYLSRSEKPDPTE--------------LTKYYP--------
---------G--------------------------
```

TABLE 15-continued shows sequence alignments of cas nucleases.

```
SmCas7x3  K-RSDKIIGH-HTFAT---D-------PDSFTGRITCKLEVVTPLIVPDTE-G------EQPKDQ----
--HKN----FPFFKINDEIMLPGAPLWAAVSQVYEALTNSCFRVMKQKRFLSWRMEAEDYK----------------
-DFYP----------------G-------------------------- oral_meta  E-RCLVPPSH-ARLQS---D---------RYTGCLTCELETVSPLLLPDTC--------REKDGN------
YKE----YPSFRLNNTPMIPGAGLRAAVSQVYEVLTNSCIRIMDQGQTLSWRMSTSEHK---------------
DYQP----------------G--------------------------

DisCas7-11  E-REEKPCGH-QKFHE---------G-RLTGKIRCKLITKTPLIVPDTS-
NDDFFRPADKEARKEKDEYHKS----
YAFFRLHKQIMIPGSELRGMVSSVYETVTNSCFRIFDETKRLSWRMDADHQN-------------VLQDFLP---
----------------G--------------------------

DsbaCas7-11  H-RDPVPPGHEEAFRG---G---------LLTGRITCRLTVRTPLIVPNTE-
TDDAFNMKEKAGK-KKDAYHKS----
YRFFTLNRVPMIPGSEIRGMISSVFEALSNSCFRIFDEKYRLSWRMDADVKE---------------LEQFKP------
-----------G--------------------------

SstCas7-11  N-RKPIPTGH-ETLNS---G---------LLTGKIRCRLTTRTPLIVPDTS-NDDFF--QTGVEG---
---HES----YAFFSVNGDIMLPGSEIRGMLSSVYEALTNSCFRVFDEGYRLSWRMEADRNV--------------
LMQFKP----------------G--------------------------

CsbCas7-11  Y-REKDIITH-EEFTE---E---------LLSGKINCKLETLTPLIIPDTS-DENGLKLQGNKPG--
-----HKN----YKFFNINGELMIPGSELRGMLRTHFEALTKSCFAIFGEDSTLSWRMNADEKD---
YKIDSNSIRKMESQRNPKYRIPDELQKELRNSGNGLFNRLYTSERRFWSDVSNKFENSIDYKREILR

CjcCas7-11  H-REQEMIGH-EQFHK---E----QKGELLVSGKIVCTLKTVTPLIIPDTE-
NEDAFGLQNTYSG------HKN----
YQFFHINDEIMVPGSEIRGMISSVYEAITNSCFRVYDETKYITRRLSPEKKD--
ESNDKNKSQDDASQKIRK----------------G--------------------------

CbfCas7-11  I-REQKMIGH-EQYYE---SYPSGASGEKLLSGRIICSMTTHTPLIVPDTG------
VIKDPENK------HAT----YDFFQMNNAIMIPGSEIRGMISAVYEAMTNSCFRIFHEKQYLTRRISPEDKE-
-------------LREFIP----------------G--------------------------

HvsCas7-11  K-RTSSPITH-ERFYE---N---------HLTGFIECSLKVLSPLIIPDTE------TPEKEENG------
HKY----YHFLKIDNKPIIPGAEIRGAVSSIYEALTNSCFRVFGEKKVLSWRMEGKDAK----------------
EFMP----------------G--------------------------

HsmCas7-11  K-RTREPIGH-NEWKK---S---------LISGYLTCRLELLTPLIIPDTS--EEVIKEKVNNGE-
-----HPV----YKFFRLGGHLCIPAAEIRGMISSVYEALTNSCFRVFDEKRLISWRMTAEEAK---
RPDPKKSEEQNRMRFRP----------------G--------------------------

FmCas7-11  E-RERHPVSH-DHIDD---K---------LLTGRLVCTLTTKTPLIIPDTQ-
TNTMLPPNDAPEG------HKS----
FRFFRIDDEVLIPGSEIRGMVSTVFEALTGSCFRVINQKAHLSWRINADMAK---------------HYRP--------
---------G--------------------------

DpbaCas7-11  E-REREPVGH-DRFQT---D---------LHTGRIICTLKTITPLIIPDTE-
NDKAFEVENASAD------HER----
FKFMRMGSQAAIPGSAIRSMTSSVFEALTNSCFRVLDQKSHLSWRMEADDAG---------------DYKP----
-------------G--------------------------
```

Domains

```
.......................................................
.......................................................
.......................................................
```

SECTION 9 (SEQ ID NOS 611-631, continued from section above)

D998

```
WmCas7x3  -----------RIVERNGELKLYPL---------------TLPTIHQNA-DNAY-----------PVPA----------
RWRKVF-YWESPV----------------------------------------------------------------
---------------------------------

SER16298.1  -----------RIVDDQGELKLQPL---------------TLPTLFGNR----N-----------NVPA----------
KWEKIFGTPSEDD----------------------------------------------------------------
---------------------------------

GwCas7x3  -----------RIVRHDQKLYLLPL---------------TLPTLPQGP-HGVY-----------DLGE----------
KWSAVF-DWQP-P----------------------------------------------------------------
---------------------------------
```

TABLE 15-continued shows sequence alignments of cas nucleases.

```
PID64649.1      -----------MVTKRGEDFWLIPL---------------AMPALSLNDEEHNY-----------KLDK---------
-RYRTMF--PDGLA-----------------------------------------------------------------
--------------------------------

WP_031436019.1  -----------MVIYVDNKSFIIKL------------------------------------------------------
--------------NDAI-------------------------------------------------------------
------------------------------------

HEB50754.1      -----------MIVLRDGKRFILPL---------------VPLM-----------------------------------
------------------EVT----------------------------------------------------------
---------------------------------

HreCas7-11      -----------IV---VDGAKIREM---------------KRYRLPLYD-T--P-----------DKTS----------
RTKEMT-CPELFTRKDG--------------------------------------------------------------
-----------------------------

CmaCas7-11      -----------RVQKKGNKYKIEKM---------------DEIVRLPIYD-N--F-----------SLVE---------
RIREYH-YSEECASYVP--------------------------------------------------------------
-----------------------------

HvmCas7-11      -----------KVKRDGNKFFILKM---------------KDFFRLPLYD-F-------------DFEG----------
EAESLR-PNYDEDRNEEENKGKNKNTQ----------------------------------------------------
-------------------------------

SmCas7x3        -----------RV--LDGGKQIKKMG--------------DKAIRMPLYD-D--S-----------TATG---------
SIKDDQ-LISDCCPKSDE-------------------------------------------------------------
--------------------------------- oral_meta       -----------KI--TDNGRKIQPMG--------------KQAIRLPLYD-E--
VIHHVSTPGDTDDLEKLKAIVLELTRPWKELP-
EEQKKKRFEKCKNILDGRMLQQKELRALENSGFAYWRDKTSLTFDSFLKDAIEQEYPRYSGDYQRI
KALVVNITLPWKLLKKEERHKRFDKCRRILKGQQPLTKDERKALEESG DisCas7-11      -----------RV--TADGKHIQKF--------------SETARVPFYD-K--TQKHFDILDEQEIAGE-----
----KPVRMW-VKRFIKRLSLVDPAKHPQKKQDNKWKRRKEGI-----------------------------------
-----------------------------------

DsbaCas7-11     -----------RV--ADDGKRIEEM---------------KEIRYPFYD-R--T--YPER-----------
NAQNGY-F-RWDARISLTDNSMRKM-EKDG-VPRNVIYKLNTLKNKAYKSEKSFLFDL----------
------------------------------------KNKAGGV SstCas7-11      -----------RV--TDNGLRIEEM---------------KEYRYPFYD-R--D-----------CSDK----------
KSQEAY-FDEWERSITLTDDSLEKMAERKGDISPKDLKVLKSLKGKNYKSTEGLLAAF----------------
------------------------------------KDKGGDT CsbCas7-11      CAGRPKNYKGGIIRQRKDSLMAEEL---------------KVHRLPLYD-N--F-----------DIPD---
----------SAYK-ANDHCRKSATCSTSRGCRERFT------------------------------------------
--------------------------------

CjcCas7-11      -----------LVKKTDEGFSIIEVERYSMKTKGGTKLVDKVYRLPLYD-S--E-----------
AVIA-------------SIQ-FEQYGEKNEKRNA---------------------------------------------
---------------------------

CbfCas7-11      -----------IVRIINGDVYIEKA--------------EREYRLPLYD-D--V-----------HIIT----------
NYEELE-YEKYIKKNPGREQ-----------------------------------------------------------
-------------------------------

HvsCas7-11      -----------RVSKKKGKLYMVKM---------------QALRLPVYD-N--P-----------ALAN---------
-EIRSGS-IYE--------------------------------------------------------------------
---------------------------------

HsmCas7-11      -----------RIIKKDKKFYAQEM---------------LELRIPVYD-N--K-----------D-------------
KRNEIS-QNDPTRPS----------------------------------------------------------------
-------------------------------

FmCas7-11       -----------RIIQNNEKMFIQPY---------------KMFRLPFYA-G--F------------------------
-------------------------------------------------------------------------------
-------------------------------

DpbaCas7-11     -----------RFEKKDDKAVIRKF---------------KKKARFPFYA-G--P----------------------
-------------------------------------------------------------------------------
-------------------------------
```

TABLE 15-continued shows sequence alignments of cas nucleases.

Domains

................................................................
................................................................
................................................

SECTION 10 (SEQ ID NOS 611-631, continued from section above)

```
WmCas7x3  --------------------PLRVY----FGS-R--------KQTYDS-R---QP-----HYLP-IQELS-
Y--------------LPND---SDCI------APDQGDLRFPSRDRDRKFLIGQCPISRYDCPIPETDLP------KLSPQERPRY----
-TR--GWVR--SLWTS-----NREK----ELPHTVK-H

SER16298.1 --------------------FLRIY----FDDIP--------SKFSSN-K---RY-----FYNCKATELKDF--------
--------IKSD---KYFIG---KRTPTV----FPKSSTEKSHLESLEFID--VEKFKKAVEN------LEITPGNNPY-----IH-
-GWVR--NLKDE-----FRE-----DIPDNVK-H

GwCas7x3  --------------------PLRIY----FDPPP--------RRTYQS-Q---QP-----CYMK-LSTVK-Y---------
-------SESN---PNQI----IAGENLGALRFPRGNQNTQFLIGQSNQD--ECPITQAEYA------QKSEDERNEY-----
TS--GWVR--TLVKP-----GR------DLPRSVK-H

PID64649.1  --------------------KLKVYLEKAYSNNV--------MKTFLN-N---EN-----TWTLAQSKIH-Y---
---------------LPLT---PIQMQ---NGGINSYYNNLRTPSRSNNFLIGQTVAH--GNGIPASGPG------AGMVP-----
------------GILR--ILGKE-----HRQN----DLPQNKK-H

WP_031436019.1 --------------------KLKQT----YTPGN--------MKDFIE-K---SN-----SWSPEHNTVY-Y---
-------------LD-----------------------------------------NNQIPQESYM------NGMKP-------------
-GILR--ILGKE-----GREQ----EL-ENKL-H

HEB50754.1 --------------------KLRHA----YTDPA--------MKHFLD-D---KN-----SWSPRCNRVY-Y-----
-----------LGRD------------------------------------------GNQIPAETRG------AGMRP--------------
GILR--LLGRE-----GRHD----AL-QNKK-H

HreCas7-11  --------------------RPERA----KKFNEEIAKVAVQNRAYLL-SLDEKERR---
EVLLGNREVT-FDECPDDEYSDDEYSELKYAQKYKDFIAVLKKNGQKRGYIKFTGPNTAN-------------
------KKN--------EDAPDKNY-----RS--DWDP--FKLNI------LLESDPECRVSN--IH

CmaCas7-11  --------------------SVKKA----IDYNRMLAQAADSNREFLY-NHPEAK-----
SILQGKKEVY-Y-ILHKQESKNRGKTKEINPNARYACLTDENTPGSRKGFIKFTGPDMVT-----------------
--VNK------ELKSKIAPIYDPEWEKDIPDWERSNQESNHKYSFILHNEIEMRSSQKK----

HvmCas7-11  -------------------KVKNA----VEFNIKMAGFAKHNRDFLK-KYKEQEIK---
DIFMGKKKVY-F--------TAGKHKPNEAHDNDKIALLTKGSNKKAEKGYFKFTGPGMVN------------------
-VKA------GVEGEECDFHIDESDPDV-YWNMS--------SILPHNQIKWRPSQKK----

SmCas7x3  --------------------KLQKA----LATNOKIALAAKHNQEYLA-QLSPDERE---
EALQGLKKVS-F--------WTESLANNEAPPFLIAKLGEERGKPKRAGYLKITGPNNAN------------------
IAN-------TNNPDDGGY-----IP--SWKD--QFDYS-----FRLLGPPRCLPNTKGNR oral_meta  FANWHGRELLFDRFLKDENSCLIKA----ETTDRVIASVAKNNRDYLF-
EIKQQDFARYKRIIQGLERVP-F---------SLRSLAKSKETSFQIACLGLRRGRFLRKGYLKISGPNNAN-----
---------------VEI------SGGSHSNSGY-----SD--IWDD--PLDFS-----FRLSGKSELRPNTQKTR DisCas7-11  --------------------ATFIE----QKNGSYYFNVVTNNGCTSF-
HLWHKPDNFDQEKLEGIQNGE-K-----LDCWVRDSRYQKAFQEIPENDP--
DGWECKEGYLHVVGPSKVE------------------FSDKKGDVINNFQGTLPSV------PN--DWKT--IRTND-----
-------FKNRKRKNE--

DsbaCas7-11  -GRYKKLVLKHAEVRGGEIPYYSHP----TPTDCKLLSLVGPNRQLCR-
QDTLVQYRIIKHRRGAKPEED-F------MFVGTPSENQK-----GHKEN----NDHGGGYLKISGPNKIE--------
------------KEN-------VLTSGVPSV-----PE--NMGA--VVHNCPP---RLVEVTVRCGRKQEEEC SstCas7-11  GGNILGLIFKYAE-RIGDVPRYEHP----TDTDRMMLSLSEYNRNQ-K-
SDGKRAYKIIKPASKLGKGAY-F------MFAGTSVENKRICNPACTDKA----NKSVKGYLKISGPNKLE---
-----------------KYN-------ISEPELDGV-----PE--DRNCQIIHNRI-----YLRKIFVANAKKR---K CsbCas7-11  --------------------CGIKV----RDKNRVFLNAANNNRQYLN-
NIKKSNHDLYLQYLKGEKKIR-F--------NSKVITGSERSPIDVIAEL--NERGRQTGFIKLSGLNNSN-------
-------------KSQ---------GNTGTTF-----NS--GWDR--FELNI------LLDDLETRPSKSD----

CjcCas7-11  --------------------KIRAA----IKRNEVIAEVARKNLIFLR-SLTPEELK---KVLQGEILVK-F-
----------SLKSGKNPNDYLAELH---ENGTERGLIKFTGLNMVN-------------------IKN------V--NEEDKDF---
--ND--TWDW--EKLNI-----FHNAHEKRNSLKQ----
```

TABLE 15-continued shows sequence alignments of cas nucleases.

```
CbfCas7-11 --------------------KIKNA----HRFNKNIARIAESNRNYLC-SLDRAVRR---EILSGRKKVN-
F--------RLVKVNDNKNPDKEAVELC---KTGPLEGLVKFSGLNAVN-------------------ISN------
LRPGTAEEGF-----DA--KWDM--WSLNI-----ILNRMDVRNSQKK----

HvsCas7-11 --------------------KYKN-----SKVEIIFFQTVEGIRKFLRGNFNNVEWKK--
VLVTGIDPLA-I----------LPSQKIPGNDKWVKNLQ--SKISPVRGYFKFTGPNKIE------------------
TKRREEEKDEKLRTKANKVSCLQ-KD--KWYE--AMHNVE---YKQDYTPPNSPKTEP-L

HsmCas7-11 ------------------EYNHP----TEPERIFFSNAEKIRNFLK-RNS--------NYLHGSTPLL-F----
--ROWSISNRYDKIA----------LIGNKSQGHLKFTGPNKIE------------------VSE---------
GTKCPKYETIPGRD--EWDK--AVHNYVEPGKFVTVISRKKGQKPKA-V

FmCas7-11 ----------------------------------------DPRNCLSE------------KQLLGIEPVK-L--------
WVKDFVASLVKPQTDIDIE----WKEKIGFVRVTGPNKVE------------------VDS-----SNTPDPSLPEC-----
ES--DWKD--IHITE--------DGSTPSKNDR----

DpbaCas7-11 ----------------------------------------DTREAFTS------------DQIMGKEKVT-
L--------
WVKDFEASLTVPDE-------IGWKKKRGYLKVTGPNKVE------------------IDT------ENISENNPSP-----PD-
-SWQD--VRIND--------DGTIPDKKNR----
```

Domains

```
................................................................
................................................................
................................................................
```

SECTION 11 (SEQ ID NOS 611-631, continued from section above)

```
WmCas7x3 QLFI--PDPVE--TPAA--DDL------------------------------LPIP-QGV-
LDTFHALADLALAGQH----W-GKDE-TPADD-QLLPFTPAGRQR----HDA---
DRPPRDADRQTRLQPGDLVCFD--LG-------D-------DGAVSEISFSSIWREGLRLAG-KPN-
LATTADLLAQ----------V

SER16298.1 HVFL--PDTTKRVSP------------------------------LEIP-PHV-KKRFHELADLALAGLH---
-L-KQGE-TIASPYKILPYTPIGRNK----LENHIHRVPNDLTCYMTRLKKGDLVFFD--VD-------N-------
DGQITEISFSSIWRAGI---GTKNK-LQTTADLLSQ----------R

GwCas7x3 HVFL--PDVFIDAPPPV--NDL-------------------------YPIP-DSV-
IQRFHDLADQVLASMN----L-KPEE-IVDST-NLLPYTPVGRRS----DSD----------CRDTRLQAGDLIFFD--
IDPPLHPG-E--------KSQITEISFSSIWRSGI---G-KDH-LLTTPDLLTN----------F

PID64649.1 ELFI--PVPDAFVADPK--TFLD---------------------TATAFLIP-RNV-
IDAFEKIAEKQTQSQKQDK-L-KHDE-------ERLPFHLKGTRR----EQN-----------HTLQIKTGDLVYFR--
PN-----A-K-------GDEVEEIAFSSIWRGKT---------SGTTADFFPD----------K

WP_031436019.1 ELFI--PVPLEYVDTEN--NKFDYQAYKK-------A------FLYRAIEIP-EPV-
LKRYSELADQRTMSQKSNKEL-KKDD-TCQSV-GWLPFHLKGTKR----QLD------
DKHNVGKLQIDEYDLIYYE--AS----------------GKEVTEVAFSSIWRGRV---ETNSS-QANKVYSFIP--------
--G

HEB50754.1 EYFI--EIPERYVD-QD--HCFDYRMFIR-------D------
RARNGTLVPISPVAWERYHCLAEERTLSQKNDPEL-REDK-ACASL-KWLPFHPKGRVR----ERD------
PENDVCHLSLRHGDLVFYA--EQ----------------NRVVSEISFSAIWRSRV---ETSDSYQAVTVDCFVP------
----K

HreCas7-11 CYPR--PLLVC----IK--DKAEYRIHKRCEAIFCSI-----GSPSDLYDIP-QKV-SNQYRTIL--
--QDYNDNTGK--IVE-IF------------RTQ----IKH-----------DQ--LTTGDLVYFK--PA--------A-------
NGQVNAVIPVSISRKTD--------ENPLAKRFKN----------D

CmaCas7-11 KYPR--PVFIC----KK--NGVEYRMQKRCERIFDFT---KEEEKDKEIVIP-QKV-
VSQYNAIL----KDNKENTET--IPG-LF-------------NSK----MVN-----------KE--LEDGDLVYFK--YK---------
------EGKVTELTPVAISRKTD---------NKPMGKRFPKISINGKMKPND

HvmCas7-11 EYPR--PVLKC----VK--DGTEYVMLKRSEHVFAEA------SSEDSYPVP-GKV-
RKQFNSIS----RDNVQNTDH--LSS-MF-------------QSR----RLH----------DE--LSHGDLVYFR--HD--------E-
-------KRKVTDIAYVRVSRTVD----------DRPMGKRFKN---------E

SmCas7x3 EYPR--PGFTC----VI--DGKEYSLTKRCERIFEDI---SGGENQVVRAVT-ERV-
REQYREIL----ASYRANAAG--IAE-GF-------------RTR----MYD----------TE-ELRENDLVYFKTAKQ-----
ADG-------KERVVAISPVCISREAD---------DRPLGKRLP-----------A oral_meta EYPR--PSFTC----TV--DGKQYTVNKRCERVFEDS-------AAPAIELP-RMV-REGYKGIL-
---TDYEQNAKH--IPQ-GF-------------QTR----FSS----------YR-ELNDGDLVYYK--TD-------S-------
QGRVTDLAPVCLSRLAD---------DRPLGKRLP-----------E
```

TABLE 15-continued shows sequence alignments of cas nucleases.

```
DisCas7-11  -----PVFCC----ED-DKGNYYTMAKYCETFFFDL------KENEEYEIP-EKA-RIKYKELL--
--RVYNNNPQA--VPESVF------------QSR---VARE----------NVEKLKSGDLVYFK--HN--------------
EKYVEDIVPVRISRTVD--------DRMIGKRMS-----------A

DsbaCas7-11 KRKRLVPEYVC----ADPEKKVTYTMTKRCERIFLEK-------SRRIIPFT-NDA-
VDKFEILV----KEYRRNAEQQDTPE-AF------------QTI----LPE----------NG-TVNPGDLLYFR--EE----------
------KGKAAEIVPVRISRKVD---------DRHIGKRID----------P SstCas7-11  ERDRLVGEFAC----YDPEKKVTYSMTKRCERIFIKD-------RGRTLPIT-HEA-
SELFEILV----QEYRENAKRQDTPE-VF------------QTL----LPD----------NG-RLNPGDLVYFR--EE---------
--------KGKTVEIIPVRISRKID---------DSPIGKRLR-----------E CsbCas7-11  -YPR--PRLLF----TK--DQYEYNITKRCERVFEID-----KGNKTGYPVD-DQI-
KKNYEDIL----DSYDGIKDQ-EVAE-RF------------DTF----TRG----------SK--LKVGDLVYFH--ID-------
G-------DNKIDSLIPVRISRKCA---------SKTLGGKLD-----------K CjcCas7-11  GYPR--PVLKF----IK--DRVEYTIPKRCERIFCIP-----VKNTIEYKVS-SKV-CKQYKDVL-
---SDYEKNFGH--INK-IF-------------TTK----IQK-----------RE--LTDGDLVYFI--PN-----EGA-------
DKTVQAIMPVPLSRITD---------SRTLGERLPH----------K CbfCas7-11  EYPR--PALHF----NH--DGKEYTIPKRCERVFVRAEAGKRAETEGSYKVP-RKV-
QEEYQNIL----RDYESNIGH--IDN-TF-------------RTL----IEN-------CG--LNNGSLVYFK--PD-----N-S--
-----RKEVVAITPVKISRKTD---------RLPQGDRFPHTS--------S HvsCas7-11  ERPRNIPCFVC----SD--KEKIYRMTKRCERVFVSL-----GENAPKYEIP-ISA-
IKRYEVIL----SAYRENWERNKTPE-LF-------------RTR----LPG----------DGRTLNEDDLVYFR--AD-------
E-------NEKVKDIIPVCISRIVD---------EVPLIKRLS-----------Q HsmCas7-11  QRRRNVPAFCC----YDYNTNRCFVMNKRCERVFKVS------RDKPKYEIP-PDA-
IRRYEHVL----RKYRENWERYDIPE-VF-------------RTR----LPG----------DGETLNEGDLVYFR--LD------
-E-------NNRVLDIIPVSISRISD---------TQYLGRRLP-----------D FmCas7-11   -------VYRC----QL--KGVTYTVAKWCEAFWVKD------EGKKPITVN-AEA-
INRYHLIM----KSYQDNPQS--PPI-IF-------------RSLPVLNYKQ----------DQKII--GSMIFYR--ES-----
AKS-------DKIVNEIIPVKISRTAD---------TELLAKHLPN----------N DpbaCas7-11 -------KFIC----QY--GTTTYTVDKWCEAFFCDE-------EKDPYELA-PDV-ERKYRLLM-
---DSYHNNPQA--PPQ-IF-------------RSLPLFSETG---------PKKTLEHGDLVYFRLSEV-----
NKQSQSKKQVRERVTDIVPVSISRIAN---------NQPIGKHIA---------A
```

Domains

........................................................
........................................................
...............................................

SECTION 12 (SEQ ID NOS 611-631, continued from section above)

```
WmCas7x3    SPHLLPLG-------------------------MPGRS-A-----RLSPVEQLFGVVEYRPPQTAK--
GTRKPTDAPAAYALAGKLQVGFGRP---ARPF-----------ER-------EP-AVTLKELSTPKPPSPALYFRPKA-
-GDGYVSKAKLASQ--------------PQ----DYAPAGRKHYLH--ALRR

SER16298.1  DPNLVQLG-------------------------MGVRT-
KNTDRFKLSPAERLFGVVEHRDDDNTTVENVNQPNDKAQAFAFAGKVRIGFGLP---DKKT-----------
TV-----NGVS-PVTLKELSSPKPPSPAFYLKRKN--NDDFVSKKVAAEC--------------SE----
TMTLRGRKCYLH--AWRE

GwCas7x3    DVNLQPHG-------------------------MPGRT-Q-----SLSPAELLFGLVGTQNDQATT--------
------AYAGKVRIGFGLP---EEGH-----------NP-----RLDA-RITLKELSSPKPPSPALYFRKKSG-
KDEYVSKANLADK--------------PE----DYILRGRKMYLH--AWRK

PID64649.1  E--LLPFN-------------------------RNRS--------RVSPAELLFGFTENNPKEMKI------D----
RGLAFAGKIRISAGTL---SDKF-----------SDTTESDLFEP-ETTLKALSSPKPPSPALYFKEKKS-
GTQYIKKQDL--N--------------PG----KHEIQGRKIYLH--ALRN

WP_031436019.1 E--LLPFN-------------------------ESRK--------KVSPAELLFGFTQINKDGSKA------DD-
--KAQAFAGKVRISAGTI---SEYP-----------EN--EANLLEQ-
EVTLKALSTPKLPSPALYFRTINGNGSAYISKQEL--E--------------PS----KHLAKGRKYYLH--ALRT

HEB50754.1  E--LRPFN-------------------------RDRR--------AISPAELLFGFVELDESEHST------
EKSRYEQMAFAGKVRLSAGLP---VEDV-----------ED---SALLEPKPIVLKALSSPKPPSPPFYFVMRDG-
SGAYIAKKDL--S--PD----------------RHRIKGRKHYLH--GLRQ

HreCas7-11  S--LRPCA-GLCVE----DCNECPARCKK-VADYFNPHP-R-----GLCPACHLFG---------
TT--------------FYKGRVRFGFAWLTGEDGAPRWYKGPD----PC--DSG-KGR-PMTIPLLERPRPT----
WSIPD--------------N-------------------SFDIPGRKFYVHHP-YSV
```

TABLE 15-continued shows sequence alignments of cas nucleases.

```
CmaCas7-11  S--LRSCS-HTCTE----DCDDCPNLCES-VKDYFKPHP-D-----GLCPACHLFG---------
TT--------------FYKSRLSFGLAWL---ENNAKWYISNDFQQKDS--KKE-KGG-KLTLPLLERPRPT-----
WSMPN--------------N-------------------NAEVPGRKFYVHHP-WSV

HvmCas7-11  S--LRPCN-HVCVE----GCDECPDRCKE-LEDYFSPHP-E-----GLCPACHLFG---------
TT--------------DYKGRVSFGLGWH--ESNTPKWYMP------ED--NSQ-KGS-HLTLPLLERPRPT-----
WSMPN--------------K-------------------KSEIPGRKFYVHHP-WSV

SmCas7x3    G--FQPCS-HVCLE----DCNTCSAKNCP-VPLYREGWPVN-----GLCPACRLFG---------
AQ--------------MYKGRVNFGFARL------P-----------DD--KQP-ETK-TLTLPLLERPRPT-----WVLPK--------
------SV-------------KGSNTEDATIPGRKFYLRHDGWRI oral_meta   E--YRPCA-HVCLE----ECDPCTGKDCP-VPIYREGYPAR-----GFCPACQLFG---------TQ--
--------------MYKGRVRFSFGVP---VN-------------ST--RSP-QLK-YVTLPSQERPRPT-----
WVLPE--------------
S-----------------CKGKEKDVPGRKFYLRHDGWRE DisCas7-11  D--LRPCH-GDWVE----DGDLSALNAYP-EKRLLLRHP-K-----GLCPACRLFG---------
TG--------------SYKGRVRFGFASL---ENDPEWLIPGK---NPG-DPF-HGG-PVMLSLLERPRPT-----
WSIPG--------------S----------------DN----KFKVPGRKFYVHHHAWKT DsbaCas7-11 E--LRPCH-GEWIE----DGDLSKLDAYPAEKKLLTRHP-K-----GLCPACRVFG---------
TG--------------SYKSRVRFGFAAL---KGTPKWLKED-----PA--EPS-QGK-GITLPLLERPRPT-----
WAVLH--------------ND-------------KE----NSEIPGRKFYVHHNGWKG SstCas7-11  D--LRPCH-GEWIE----GDDLSQLSEYP-EKKLFTRNT-E-----GLCPACRLFG---------TG--
------------AYKGRLRFGFAKL---ENDPKWLMKN-----SD--GPS-HGG-PLTLPLLERPRPT-----WSMPD----
--------------DTLNRLKKDGKQEPKKQKGKKGPQVPGRKFYVHHDGWKE CsbCas7-11  A--LHPCT-GLS----------------------------D-----GLCPGCHLFG---------
TT--------------
DYKGRVKFGFAKY---ENGPEWLI-------TR--GNN-PER-SLTLGVLESPRPA-----FSIPD---------------D------
---------------ESEIPGRKFYLHHNGWRI CjcCas7-11  N--LLPCV-HEVN-----EGLLSGILDSL-DKKLLSIHP-E-----GLCPTCRLFG---------TT-----
-----------YYKGRVRFGFANL---MNKPKWLT-------ER--ENG-CGG-YVTLPLLERPRLT-----WSVPS---------
----------D--------------------KCDVPGRKFYIHHNGWQE CbfCas7-11  D--LRPCV-RDCLDT---EGDIRMLENSP-FKRLFHIHP-E-----GLCPACQLFG---------TT--
-------------NYRGRVRFGFASL---SDGPKWFR-------KD--EGN-ETC-HITLPLLERPRPT-----WSMPD--------
--------------D--------------------TSTIPGRKFYVHHMGYET HvsCas7-11  E--LWPCVLAECPLLGF-ECKKCELEGLP-EKIWFRINK-D-----GLCPACRLFG---------
TQ--------------IYKSRVRFSFAYA------KNW--------------KF-YDG-YITLPRLESPRAT-----
WLILK-----------
---E--------------KDKHYIKYKVCGRKFYLHNSTYED HsmCas7-11  H--LRSCV-RECLYEGWGDCKPCKLSLFP-EKMWIRINP-E-----GLCPACHLFG---------
TQ--------------VYKGRVRFGFARA-----GSNW--------------KF-REE-QLTLPRFETPRPT-----WVIPK---------
------R--------------KD----EYQIPGRKFYLHHNGWEE FmCas7-11   D--FLPCA-ATCLN----ECDTCNAKTCKFLPLYREGYPVN-----GLCPSCHLFG---------
TT--------------GYQGRVRFGFAKM---NGNAKFCQ-------GG--ERP-EDR-AVTLPLQERPKLT-----
WVMPN--------------E-------------------NSTIPGRKFFLHHQGWKK DpbaCas7-11 A--FRPCA-YVCIE----ECEPCDAKTCP-IPVYREGYPIK-----GLCRACHLFG---------TT--
-------------GYKGRVRFSFAKL---NGDAVW---------AK--GAG-GKD-YFTLPLLEKPRPT-----WTMPN-----
-----------E--------------------GAKIPGRKFYVHHNEWKT
```

Domains

```
. . . . . . . . . . . . . . . . . . . . . . . . . . . . . . . . . . . . . . . . . . . . . . . . . . . . . .
. . . . . . . . . . . . . . . . . . . . . . . . . . . . . . . . . . . . . . . . . . . . . . . . . . . . . .
. . . . . . . . . . . . . . . . . . . . . . . . . . . . . . . . . . . . . . . . . .
```

SECTION 13 (SEQ ID NOS 611-631, continued from section above)

```
WmCas7x3    QG---QVARLDNSGHVPSDGSGRPPW------QSRFDG--------QEDSGNK----
RRVRVEPIPAGETFHFEIDFDNLSPTELEQLCATLLP-HPAFEHRLGMGKPIGLGSVKLAVEGL---
LLVDRPRRYAEDEPNAPRHHRGW--RAN--ADAG--WPDHLQGDSPAAPLEAT-EQP-AALAERAMA---
------
SER16298.1  QNG--NVMKLDAIGVNSGGSTCKPPWKTHKPAANDQKE---------
FEEDKNKFITSRQVKIAPISENTPFYFEIDFNNLDATELAQLCATLQP-
APKFEHRLGMGKPLGLGSVKIEPVGL----FLINRHQRYTTDSTNCDRYHYAW--LKG--
EHAAWDWPEYFRQNVVTADCTQTFNDTFDKLVQNGLA---------
```

TABLE 15-continued shows sequence alignments of cas nucleases.

```
GwCas7x3       NE---QVVELSDTGH---DGGVRPPW------VSKFDE--------SADEGNK----
               RRVSIEPIAKDESFYFEVDFHNLSRTELAQLCATLYP-NEKFEHRLGMGKPLGLGSIKITPLSL---
               FLVNRSQRYATDGLDKPRYHAVW--HTG--TASEPRWPDHLQREQQGIAFEGVSTAP-TVMSLAAEA--

PID64649.1     ENN-QNVQRITSQGKFDNAANRTQPW----------VS--------QNEERNH----
               LKTKCKPLKSGLNFFFHIDFNNLTQWELGLLCYALRP-CETFRHKIGMGKPIGLGTVKIDIAVL---
               QTIDRYARYTDTTQDSERYNQGA--WIS--QELQNEIPN--QYKGKGISNKKGMLSP-EDCRKVEME------
               ---

WP_031436019.1 GDN--KVQKLGSQGETANGGDSKLPW---------VTH--------NPDERPQ----
               LKVKIKPIKAE--FIFSLDFNNLTEWELGLLCYALRP-TDSFRHRIGMGKPLGLGSVKIDIMAL---
               QTINRQQRYAQDGLEENRFNRHN--WVN--PPHQPRL----EKAGYSISLSSTPLNP-EILRATFTK---------

HEB50754.1     RGNPDRVQSLDRYGH-ATETAANPPW---------ETC--------HPEERPQ----
               IKVRVQPVRRKTKFFFHLDFSNLSRWELGLLCYVLRP-TACFRHKLGMGKPLGLGSVRIDIASL---
               QLIDRVRRYGTDDLTAGRYNMGG--HFN--ASCLDLLP---QQDSPAPDDSGAAPDP-GTLRQDFVK-----
               ----

HreCas7-11     ----D--------GI----------------------------DGETRTP----
               NNRTIEPLAEGNEFVFDIDFENLRDWELGLLLYSLEL-EDSLAHKLGLGKPLGFGTVQINIRGI---
               SLKN--------------GSKG--WDTKTGDDKNQWIK----KGF-----------AHLGIDIKE---------

CmaCas7-11     ENI-K--------NNQGN-----------------QKDISLKPDSDAIKIKE----
               NNRTIEPLGKDNVFNFEISFNNLRDWELGLLLYAIEL-EDHLAHKLGMAKAFGMGSVKIEIKNL---
               LIKG--------------SIND--------ISKAELIK----KGF-----------KKLGIDSLEKD-------

HvmCas7-11     DKI-R--------NRQFD-----------------PAK-EKQPD-DVIKPNE----
               NNRTVEPLGKGNEFTFEVRFNNLREWELGLLLYSLEL-EDNMAHKLGMGKALGMGSARIKAEAI---
               ELRC--------------ESA---GQNAELKDKAAFVR----KGF-----------EFLEIDKPGEN-------

SmCas7x3       -VM-A--------GTNPI-----------------TG--------ESIEKTA----
               NNATVEAIMPGATFTFDIVCENLDQQELGLLLYSLEL-EEGMSHTLGRGKPLGFGNVRIKVEKI---
               EKRL--------------SDG---------SRREMIPP----KGA-----------GLFMTDKVQDALRGLTEG oral_meta      MWG-D--------DDKPD----------------------------SRPSSEE----
               CQDIIEGIGPGEKFHFRVAFENLDKNELGRLLYSLEL-DAGMNHHLGRGKAFGFGQVKIRVTKL---
               ERRL--------------EPGQ--WRS--EKICTDLPV----TSS-----------ELVISSLKK---------

DisCas7-11     -IK-D--------GNHPT-----------------TG--------KAIEQSP----
               NNRTVEALAGGNSFSFEIAFENLKEWELGLLIHSLQL-EKGLAHKLGMAKSMGFGSVEIDVESV---
               RLRK--------------DWKQ--WRN-GNSEIPNWLG----KGF-----------AKLKEWFRD---------

DsbaCas7-11    -IS-E--------GIHPI-----------------SG--------ENIEPDE----
               NNRTVEVLDKGNRFVFELSFENLEPRELGLLIHSLQL-EKGLAHKLGMAKSMGFGSVEIDVESV---
               RVKH--------------RSGE--WDYKDGETVDGWIE----EGK-----------RGVAAKGKA---------

SstCas7-11     -IN-C--------GCHPT-----------------TK--------ENIVQNQ----
               NNRTVEPLDKGNTFSFEICFENLEPYELGLLLYTLEL-EKGLAHKLGMAKPMGFGSIDIEVENV---
               SLRT--------------DSGQ--WKD-ANEQISEWTD----KGK-----------KDAGKWFKT---------

CsbCas7-11     -IR-Q--------KQLEI----------------------------RETVQPE----
               RNVTTEVMDKGNVFSFDVRFENLREWELGLLLQSLDP-
               GKNIAHKLGKGKPYGFGSVKIKIDSLHTFKINS--------------NNDK--IKRVPQSDIREYIN----KGY-------
               -----QKLIEWSGNNSIQKGNVL

CjcCas7-11     -VL-R--------NN-------------------------------DITPKTE----
               NNRTVEPLAADNRFTFDVYFENLREWELGLLCYCLEL-
               EPGMGHKLGMGKPMGFGSVKIAIERLQTFTVHQ--------------DGIN--WKP-SENEIGVYVQ----KGR----
               ---------EKLVEWFTPSAPHKNM--

CbfCas7-11     -VK-K--------NQ-------------------------------RTLVKTE----
               NNRTVKALDKENEFTFEVFFENLREWELGLLLHCLEL-
               EPEMGHKLGMGKPLGFGSVKIRIDKLQKCVVNV--------------KDGCVLWEP-EEDKIQHYIA----KGL--
               -----------GKLTTWFGK---------

HvsCas7-11     IIN-N--------SKK------------------------------EKEKKTE----NNASFEVLKEG-
               EFTFKVYFENLENWELGLLLLSLT--GLGEAIKIGHAKPLGFGSVKIEAKKI---YFRE--------------
               EAGK--FHP--CEKADEYLK----KGL-----------NKLTSWFGK---------

HsmCas7-11     IYK-K--------NKK------------------------------NEIKKEK----NNATFEVLKQG-
               TFYFKVFFENLELWELGLLIFSAELGGEEFAHKLGHGKALGFGSVKISVDKI---ILRR---------------
               DPGQ--FEQRGQKFKRDAVD----KGF-----------CVLENRFGK---------

FmCas7-11      IVD-E--------GKNPI-----------------NG--------DVIEPDA----
               NNRTVEPLAAGNDFSFEVFFENLREWELGLLRYTLEL-ESELAHKLGMGKAFGFGSVKIKIKSV---
               DLRK--------------QGE-------------WEK----ATN-----------TLVSEDKKS---------
```

TABLE 15-continued shows sequence alignments of cas nucleases.

```
DpbaCas7-11  -VQ-E--------GKNPI-----------------DQ--------KAIRPNP----
NNSSVEVLNLGNEFQFEVSFENLEEWELGLLLYCLEL-EPGLAHKLGRGKAFGFGSIEAEVSKI---
EMRI---------------KSGT--WKNE-TSGKEKFIQ----SGL-----------SQVPSFFKQDEK------
```

Domains

................................................
................................................
................................................

SECTION 14 (SEQ ID NOS 611-631, continued from section above)

```
WmCas7x3     ---RVPADVRRALQLLGNP----GAVAAPVHYPQVKDAQIE--EKH---YLWFVANDD--
---------------EKTAGGNRH---------------LPRL-----HANSPGLPTLPRLV-----KREKDHSSNTGKPRRK--------
--------------------------------------------------

SER16298.1   ---GTDADIKHALQLLGDP----QYIGVPVHYPIAGNSTLE--NKH---FEWFGNNDK------
----ASVLRQKAQANSKNHHYQPKQQATPEEPQYLHTI-----
TKDSKQISLLKKNKIEDIENRDQQKHRYSNHRR--------------------------------------------------------
---

GwCas7x3     ---KVSDDVKRALELLGNP----DEITVPVHYPQLHNGLME--SKQ---FDWFVQNDK-----
-----------SGRDQPANNRQH-------------LSSF-----TKDTEKLEPLIRIM----------------RR-------------
--------------------------------------------------

PID64649.1   ---TMDADIQRAIELLGDP----GNVTSPVHYPQLDRKNIE--TKN---YEWFKQNEI--------
--------------EQQV---------------LKPI-----TKNTTHLTPFAR-----------------WEQG--------------
--------------------------------------------------

WP_031436019.1 ---TMNADIYRTLELLGNP----QNVKRPVHYPQVENHNIE--QEN---YKWFVANDQ-
-----------GSGKGRNKIDPAEKA---------------LKIL-----TENSDCLPTLSRLD-----------------WRDE------
--------------------------------------------------

HEB50754.1   ---TMDETVFRALDLLGNP----AHVQRPVHYPQVREMDIE--DQT---FLWFVDNDK----
------------------QWKDA---------------LQPL-----TSSSTQLPPLTRRN-----------------KR------------
--------------------------------------------------

HreCas7-11   --ANERPYIKQLRELLWVP---TGDNLPHVRYPELESKTKD-----VPGYTSLLKE--------
--KDL---------ADR---------------VSLL-----KA---PWKPWKPWS-----
GTAPHPDKGTNRLRASIVERDRIQRKTDTAKPEKKEETKVGKSSSSDIEKRYVGTVKWENDKKGYG
FI-LYGTD

CmaCas7-11   -DLSEYLHIKQLREILWFS----DKPVGTIEYPKLENKTNS----
RIPSYTDFVQEKDHETGFKNPKYQNL----------KSR---------------LHIL-----QN---PWNAWWKNE-----E----

HvmCas7-11   -DPMNFDHIRQLRELLWFL---PENVSANVRYPMLEKEDDG-----
TPGYTDFIKQEEPSTGKRNPSYLSS---------EKR---------------RNIL-----QT---PWKHWYLIP-----
PFQASAQSETVFE----------------------------------------GTVKWFDDKKGFGFIKINDGG

SmCas7x3     GDWHQRPHISGLRRLLTRY------PEIKARYPKLSQGEDK-----
EPGYIELKSQKDENGVPI----YNP----------NRE---------------LRVS-----EN---GPLPWFLLA-----KK-------
-------------------------------------------------- oral_meta    -----VEERRKLLRLVMTP-----YKGLTACYPGLERENGR------PGYTDLKML------------
ATY---------DPY---------------RELVVQIGSNQ---PLRPWYEPG-----
KSFKPSPGNDCTGRGGSVSKSLISEPKVV----------------PAIAPFCEGVVKWFNSVKGFGFI-ETKEQ DisCas7-11   ----ELDFIENLKKLLWFP----EGDQAPRVCYPMLRKKDDP--NGN-SGYEELKDGE-------
----FKK---------EDR---------------QKKL-----TT---PWTPWA----------------------------------
---------------------------------------

DsbaCas7-11  ---------NDLRKLLYLP---GEKQNPHVHYPTLKKEKKG----DPPGYEDLKKSFR----------
EKK---------LNR---------------RKML-----TT---LWEPWHK------------------------------------
---------------------------------------

SstCas7-11   -DWEAAEHIKNLKKLLFLP---GEEQNPRVIYPALKQKDIP--NSRLPGYEELKKN--------
----LNM---------EKR---------------KEML-----TT---PWAPWHPIK-----K--------------------------
---------------------------------------

CsbCas7-11
PQWHVIPHIDKLYKLLWVPFLNDSKLEPDVRYPVLNEESKGYIEGSDYTYKKLGDKDN----------LPY-
---------KTR---------------VKGL-----TT---PWSPWNPFQ-----
VIAEHEEQEVNVTGSRPSVTDKIERDGKMV------------------------------------------

CjcCas7-11   -EWNGVKHIKDLRSLLSIP-----GDKPTVKYPTLNKDAEG--AISDYTYERLSDTKL-----
-----LPH---------DKR---------------VEYL-----RT---PWSPWNAFV-----KEAEYSPSEKSDEKGRETIRTKPK-
--------------------SLPSVKSIGKVKWFDEGKGFGIL-IMDDG
```

TABLE 15-continued shows sequence alignments of cas nucleases.

```
CbfCas7-11  -EWDRLEHIQGLRSLQRLL-------------
PL----------------------------------------------------
------------------------------------------------------------------------------------
-------------------------

HvsCas7-11  --NEINEHMRNLLLFMTYY-----QNLPKVKYPDF------------DGYAKWRCS------------
YVE---------QDK---------------VEYF-----QN---RWI-
VAS----------------------------------------
------------------------------------------

HsmCas7-11  -TNFKI-YLNNFLQLLYWP----NNKKVKVRYPYLRQEDDP--EKL-PGYVELKKH------
------QML---------KDD---------------NRYSLFARPRA---VWLKWTEMV-----
QRDKS----------------------
------------------------------------------

FmCas7-11   -SWYNIHTVNNLRTALYYV----EDDKIQVNYPKLKKDNES---DNRPGYVEMKKTA--
---------FPV---------RDI---------------L---------TT---PWWPWWPPT-----PPPMNQSGNQSYARSEE-
PARITE--
--------------------SQPEVYKTGTVKFYKHDKKFGFITMDGRE

DpbaCas7-11 -QWNKVEQVKNIRKLLQLSWNKGNAVEPEVRYPALREKDDE--NKR-
PGYVELKDNG----------Y------------DA---------------GKKL-----VS---PWAPWHPIK-----
K------------
------------------------------------------------------------
```

Domains

```
.................................................................
.................................................................
..........................................
```

SECTION 15 (SEQ ID NOS 611-631, continued from section above)

```
WmCas7x3    --------------------------------------------

SER16298.1  --------------------------------------------

GwCas7x3    --------------------------------------------

WP_031436019.1 -----------------------------------------

PID64649.1  --------------------------------------------

HEB50754.1  --------------------------------------------

HreCas7-11  EEIFVHRSGVADNSIPKEGQKVGFRIERGARGSHAVEVKAIE---

CmaCas7-11  --------------------------------------------

HvmCas7-11  KDVFVHHSSIVGTGFKSLNEGDSVAFKMGVGPKGPCAEKVKKIGN

SmCas7x3    -------------------------------------------- oral_meta   RDIFVHFSAIRGEGYKILEPGEKVRFEIGEGRKGPQAINVIRIR-

DisCas7-11  --------------------------------------------

DsbaCas7-11

SstCas7-11  --------------------------------------------

CsbCas7-11  KEVSISKNSIRGNILLKKGQKVTFHIVQGLIPKAEDIEIAK----

CjcCas7-11  --------------------------------------------

CbfCas7-11  --------------------------------------------

HvsCas7-11  --------------------------------------------

HsmCas7-11  --------------------------------------------

FmCas7-11   NIHFAGNQICRPET--SLQSGDKVKFIEGENYKGPTALKVERLKG

DpbaCas7-11 --------------------------------------------

Domains     .............................................
```

EXAMPLES

While several experimental Examples are contemplated, these Examples are intended non-limiting.

Example 1

Cas7-11 Family

New Cas7-11 family members were mined from bacterial and metagenomic data downloaded from NCBI, JGI, and ENA repositories. CDS were extracted using MetaGeneMark (Besemer and Borodovsky 1999; Zhu et al. 2010), and used to build BLAST databases (Camacho et al. 2009). Existing Cas7-11 family members (Makarova et al. 2019) were used as seeds to find putative orthologs. In parallel CRISPR arrays were identified using both CRISPRCas-Finder (Couvin et al. 2018) and PILER-CR (Edgar 2007), and putative orthologs were filtered for proximity to CRISPR arrays.

Cas7-11 family members were computationally identified and expressed. The Cas7-11 family is summarized in the trees presented in FIG. 2A. The type III-E Cas7-11 locus from *Desulfonema ishimotonii* (DisCas7-11) comprises multiple Cas7-like gRAMP domains, including a small subunit domain and an unknown insertion in the Csm3-like domain 5 (FIG. 2B). The CRISPR array was expressed in *Desulfonema ishimotonii* and processed into mature crRNAs containing 14-nt direct repeats (DRs) and ~31 nt spacers (FIG. 2C). The cleavage site for processing and maturation is illustrated in FIG. 2D.

Figure 2A:
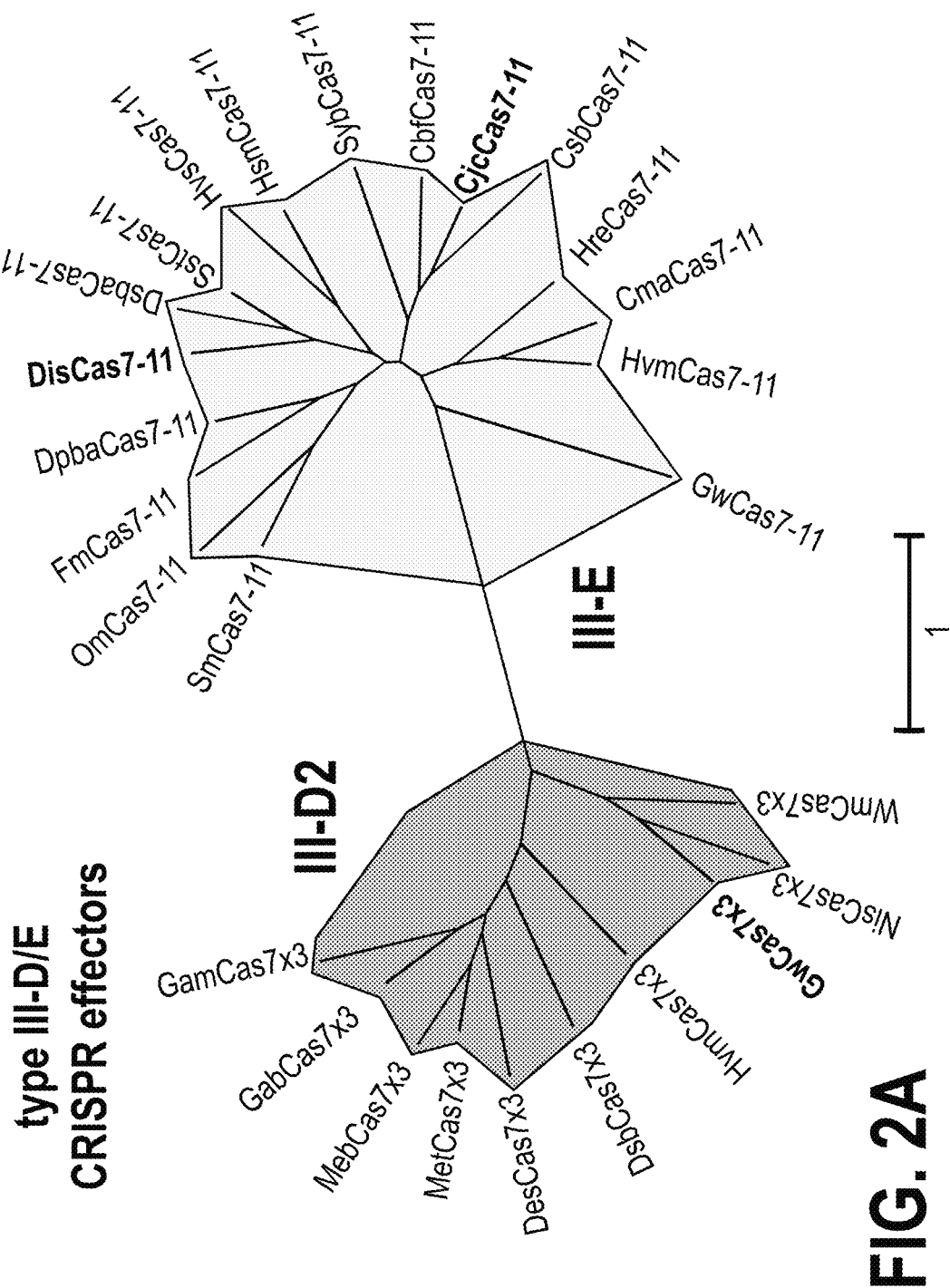
FIG. 2A illustrates tree of type III-D2 and III-E effectors based on Cas7-11 and Cas7×3 multiple alignment via a computational discovery pipeline according to embodiments of the present teachings.
Figure 2B:
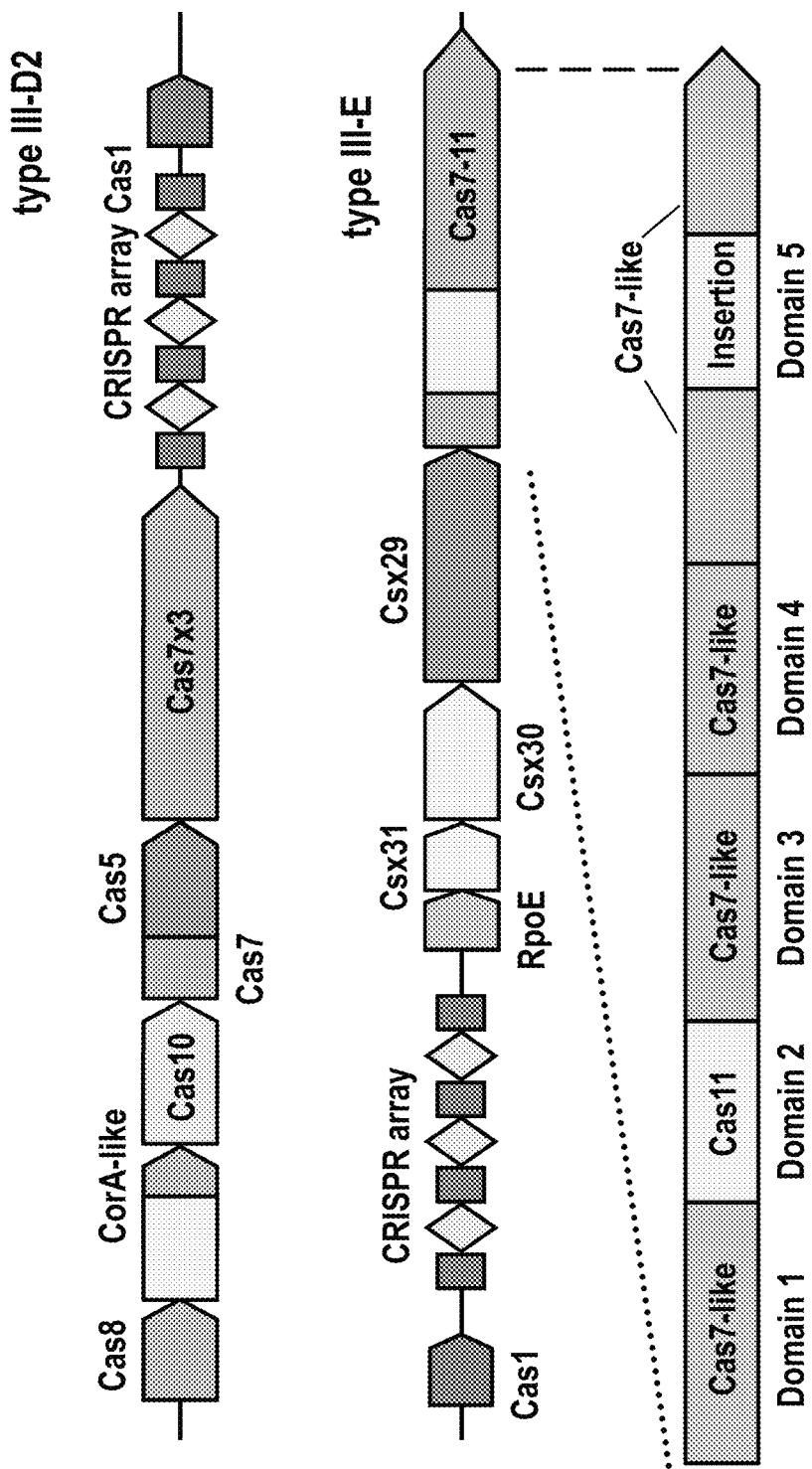
FIG. 2B is a schematic of a typical type III-E Cas7-11 locus and type III-D2 Cas7×3 locus wherein the inset shows the multiple Cas7-like domains of Cas7-11 including a putative small subunit Cas11 domain and an uncharacterized insertion in the Cas7-like domain 5 according to embodiments of the present teachings.
Figure 2C:
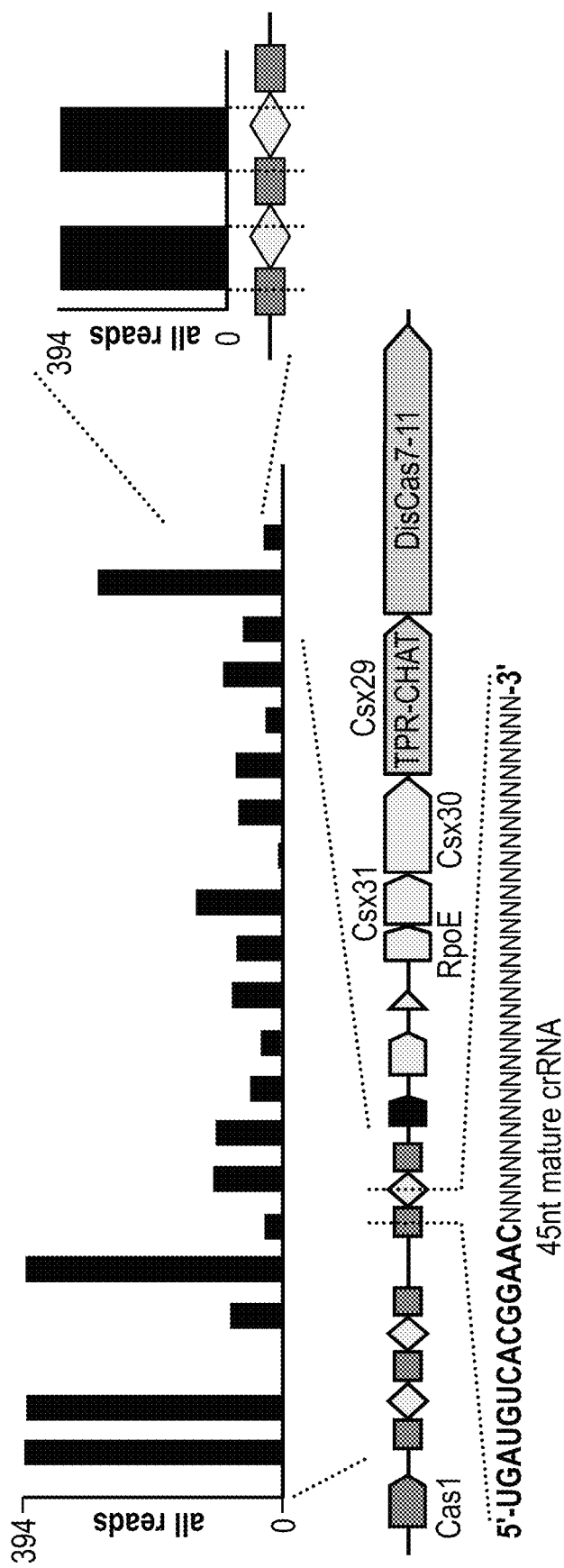
FIG. 2C illustrates a native expression of a CRISPR array associated with DisCas7-11 according to embodiments of the present teachings. Figure discloses SEQ ID NO: 633.
Figure 2D:
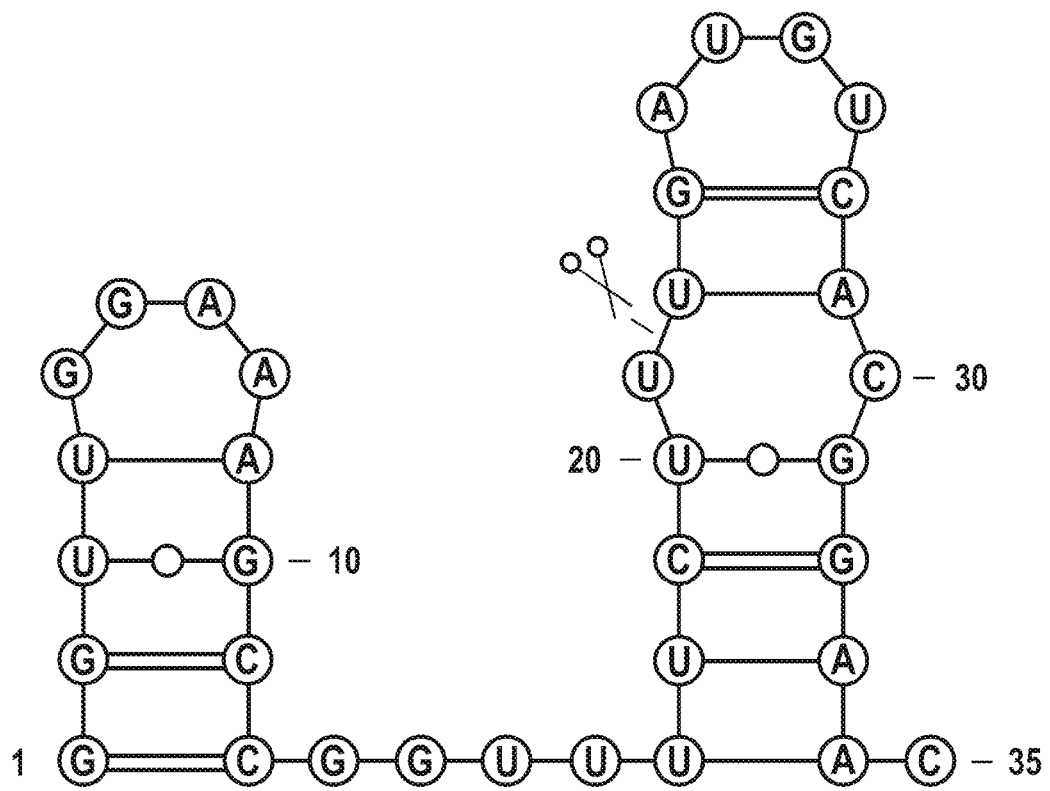
FIG. 2D is a schematic representation of a DR secondary structure and a scissor denoting the cleavage site for processing and maturation according to embodiments of the present teachings. Figure discloses SEQ ID NO: 634.

By screening a database of bacterial genomic and metagenomic sequences from diverse sources containing more than ~11.6 billion protein sequences, the set of subtype III-E systems was expended to 17 loci from various bacteria and metagenomes (FIG. 2A). Apart from the identification of many additional type III-E loci, a novel subset of III-D systems (subtype III-D2) that was characterized by the fusion of 3 Cas7 domains into a single protein, referred to as Cas7×3 was identified (FIG. 2A and FIG. 2B and Table 1). This similarity of the domain architectures, together with the phylogenetic analysis of the Cas7 domain (FIG. 2A), suggests an evolutionary path from subtype III D1 to III-D2 via the fusion of 3 Cas7 proteins, and then, from III-D2 to III-E via the fusion with an additional Cas7 and the Cas 11 protein.

Figure 1E:
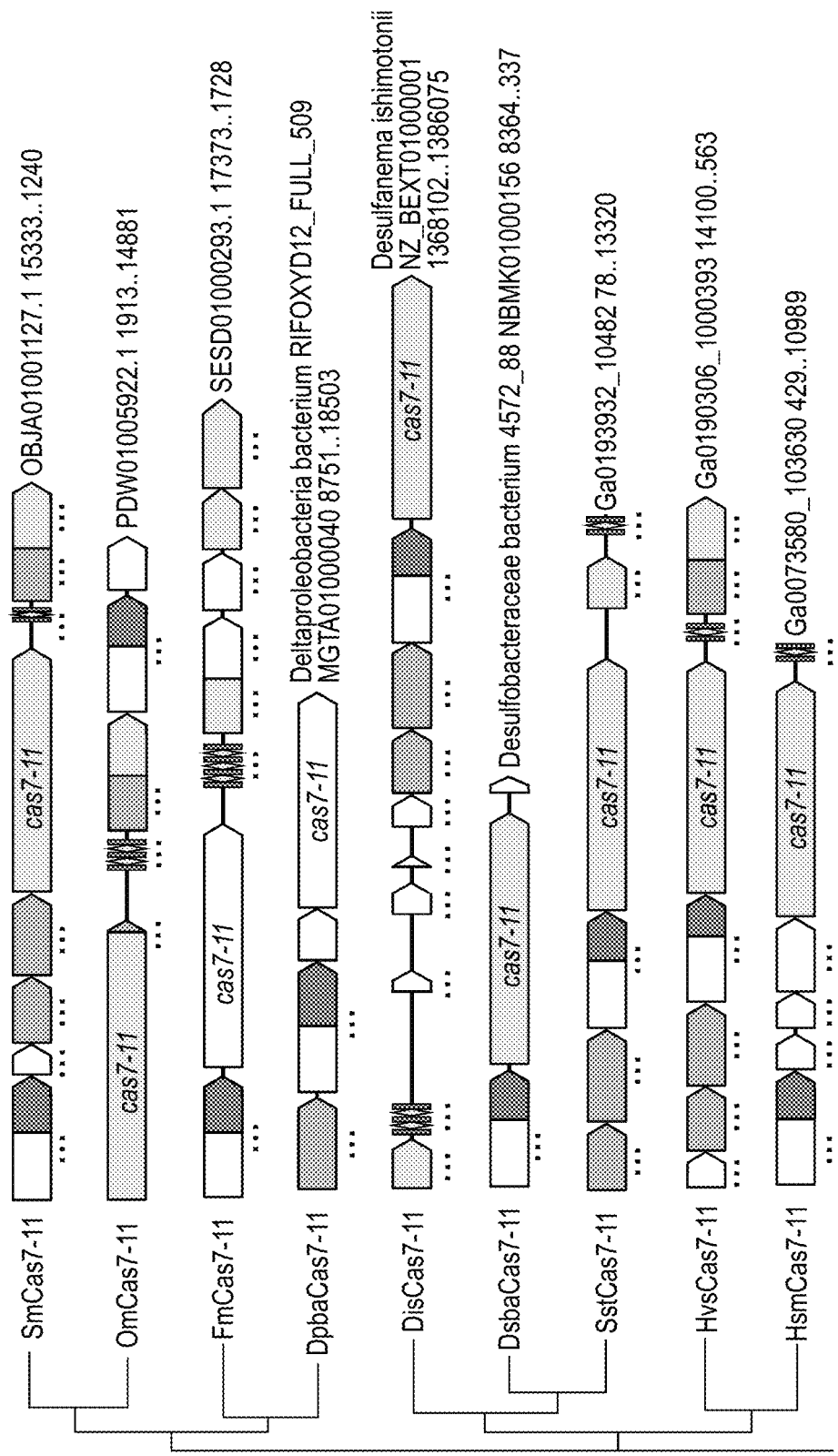
FIG. 1E shows type III-E family members and type III-D2 loci architecture and multiple alignment of representative orthologs, wherein CRISPR array symbols are not representative of the number of spacers in the array according to embodiments of the present teachings.
Figure 1E:
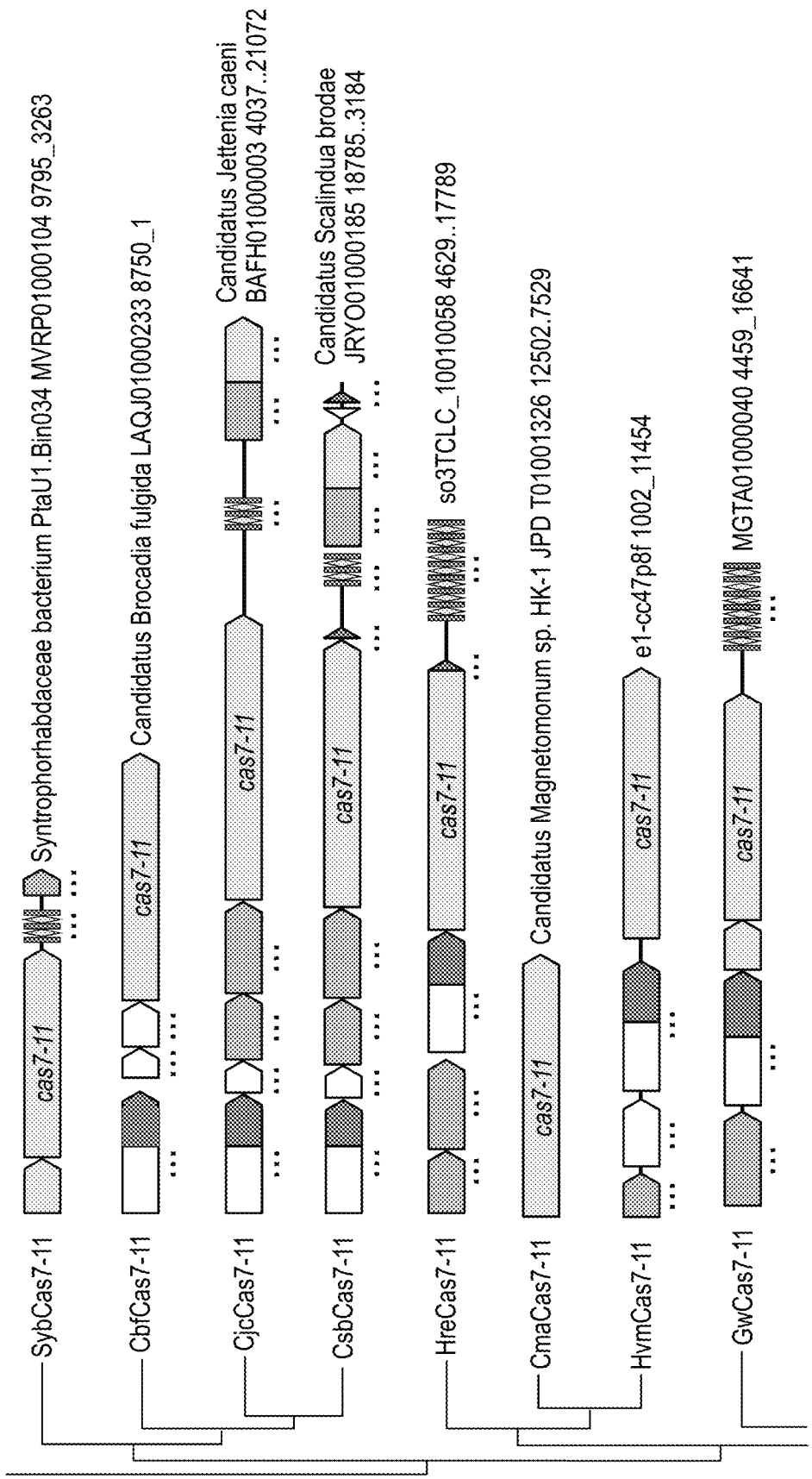
Figure 1E:
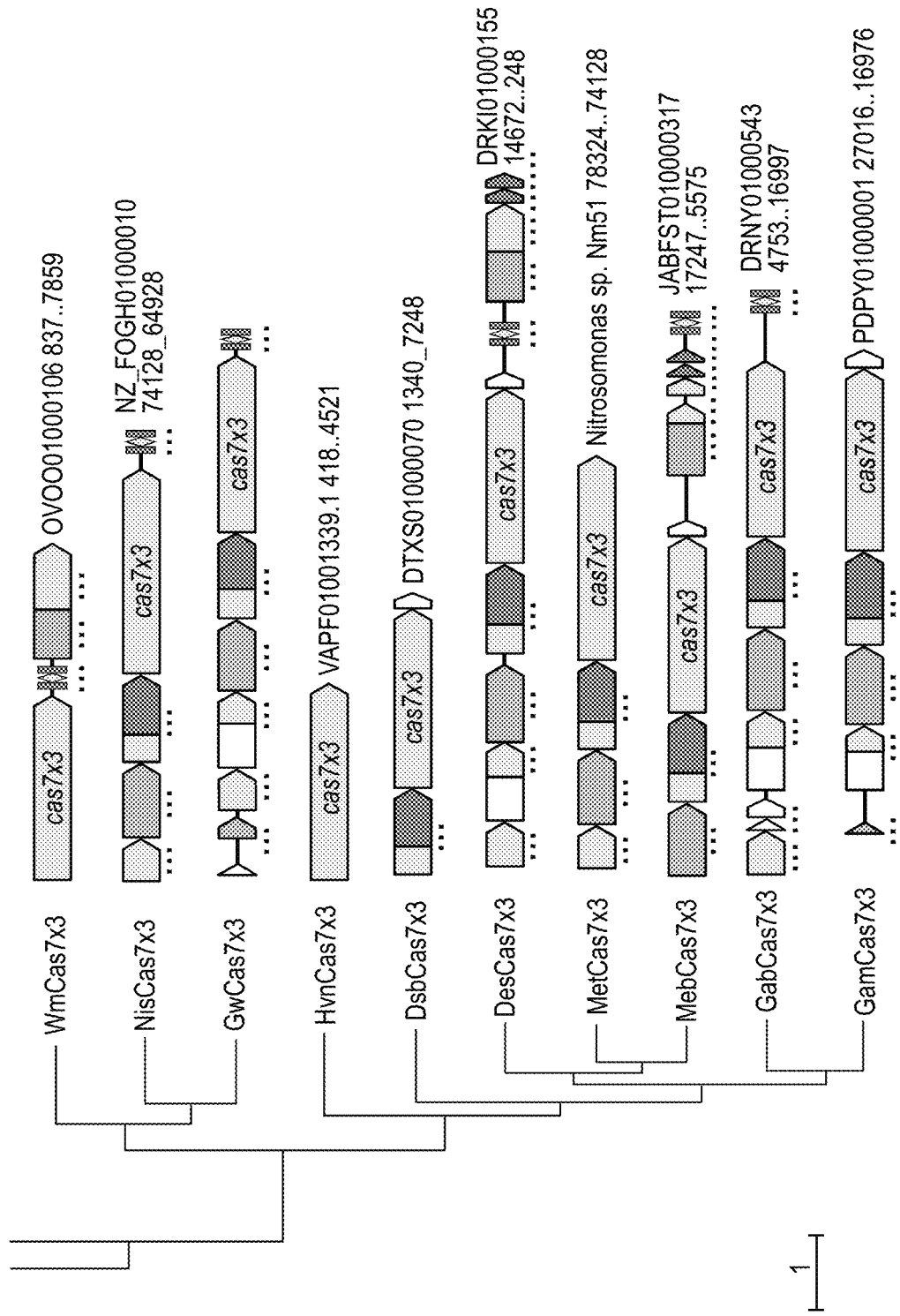

Examination of the extended set of type III-E systems confirmed that almost all III-E loci (15 of the 17) contained the TPR-CHAT protein (Csx29), and a majority encompassed uncharacterized proteins denoted Csx30 (10/17) and Csx31 (9/17) as well as the alternative sigma factor RpoE (8/17) (FIG. 1E). The frequent presence of these genes in the III-E loci suggests that the respective proteins play accessory roles in the CRISPR response. More than half of the III-E loci (9/17) also contain the adaptation gene Cm' which, in 8 of these 9 loci, is fused to a reverse transcriptase (RT), in a common arrangement among the type III systems, as well as a CRISPR array (12/17). Searching the spacer sequences against the NCBI NT (nucleotide sequences) database did not identify any matches, in agreement with the previous observations that the majority of the CRISPR spacerome consists of "dark matter" that apparently reflects vast, still unexplored viromes. Furthermore, alignments of the Cas7 domains of the Cas7×3 and Cas7-11 proteins show conservation of acidic residues implicated in crRNA guided target cleavage (FIGS. 1F-1K). The activities of Cas7-11 and Cas7×3 proteins were experimentally characterized to assess the path of evolution that resulted in the unique Class 1 single protein effector that is predicted to function as a programmable RNase without collateral activity.

Example 2

Cas7-11 Defense

The RNA-guided RNA-targeting Cas7-11 was demonstrated to be capable of defense against ssRNA MS2 phage and RNA knockdown in bacteria.

Figure 3A:
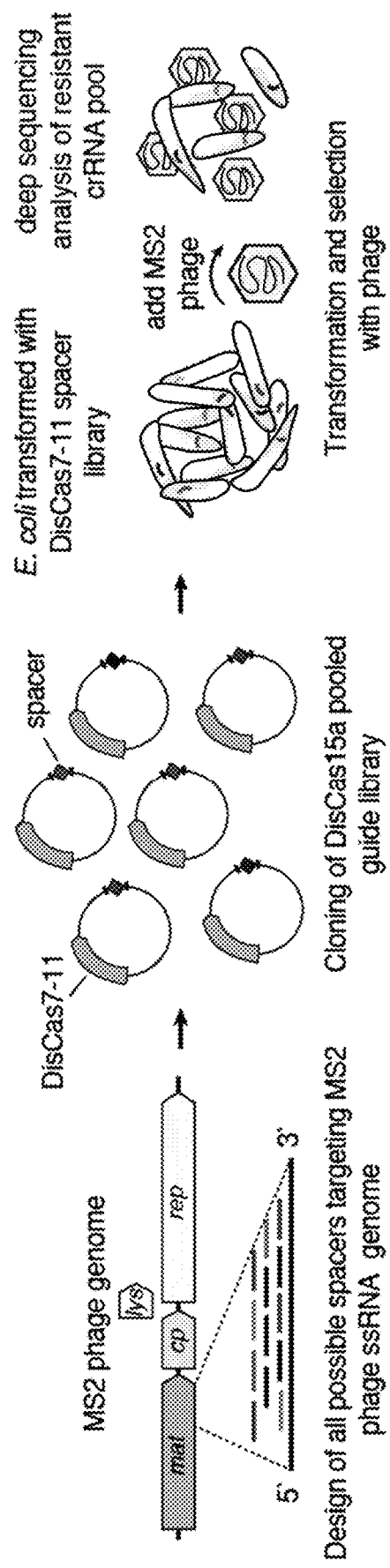
FIG. 3A illustrates the CRISPR array screen of RNA-guided RNA-targeting Cas7-11 for all crRNAs targeting the MS2 phage genome according to embodiments of the present teachings.
Figure 3B:
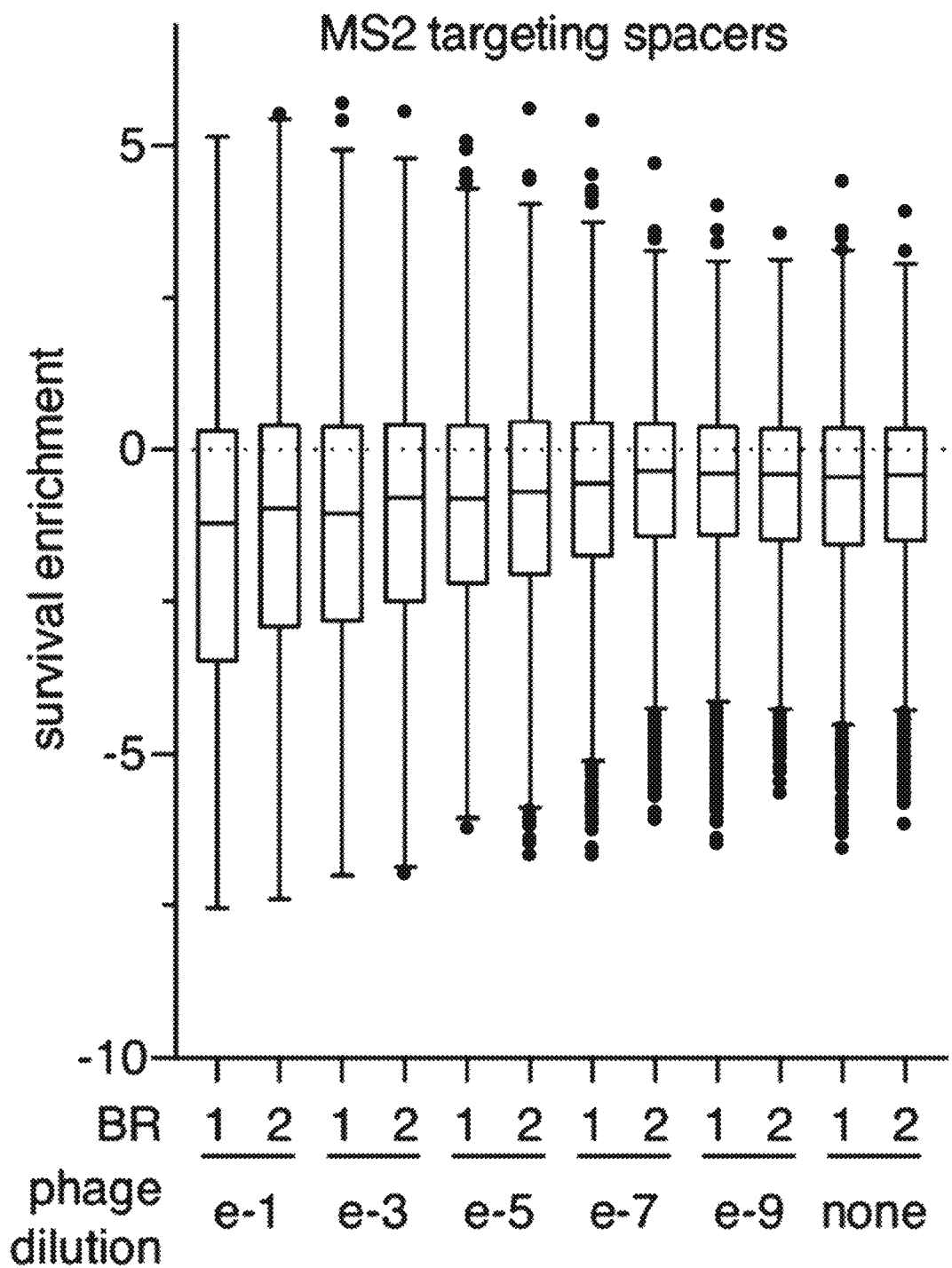
FIG. 3B is a diagram showing results of the MS2 interference screen (for the MAS targeting spacers) according to embodiments of the present teachings.
Figure 3C:
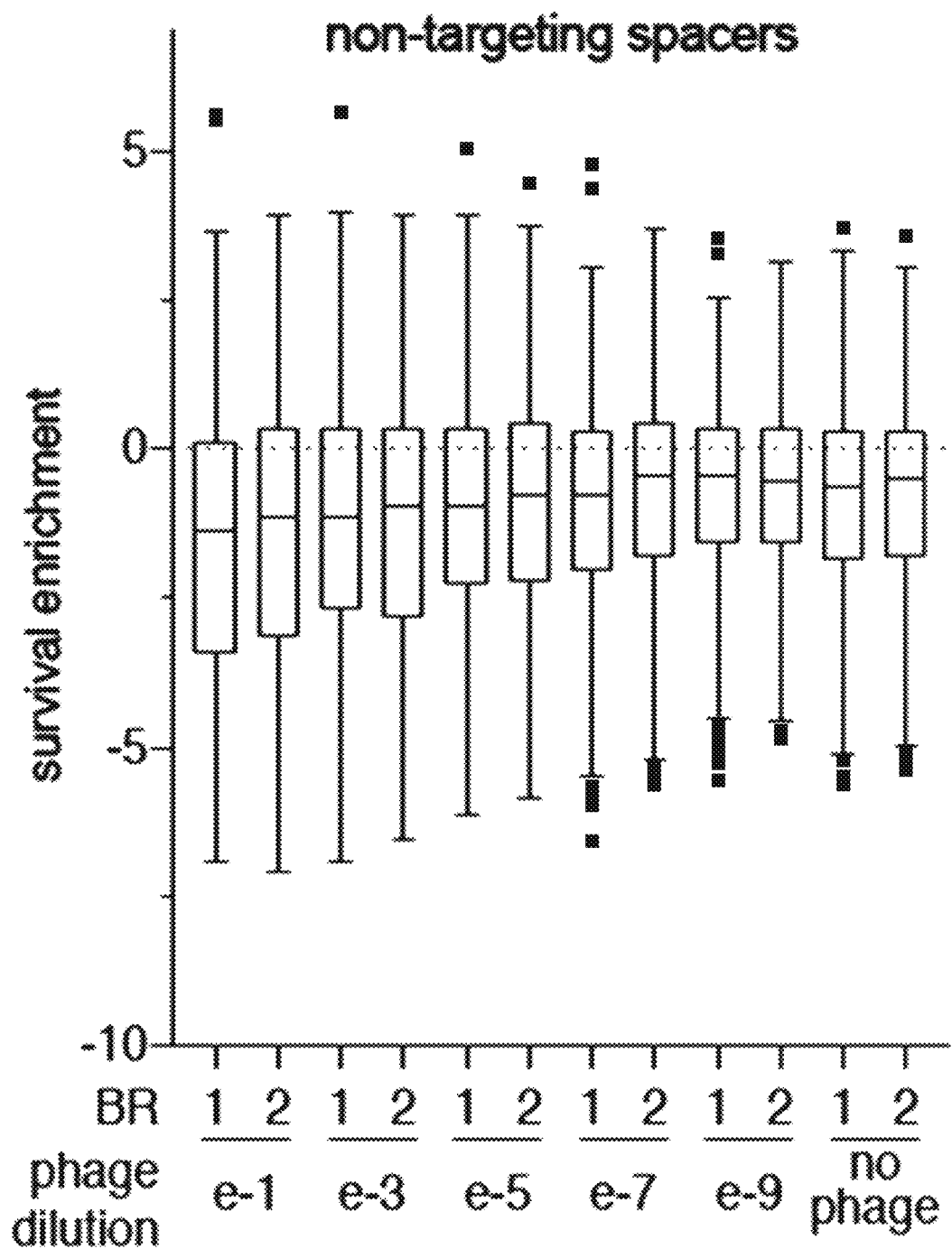
FIG. 3C is a diagram showing results of the MS2 interference screen (for the non-targeting spacers) according to embodiments of the present teachings.

The CRISPR array screen of all crRNAs targeting the MS2 genome was performed (FIG. 3A). The results of the MS2 interference screen is shown in FIG. 3B (for MS2 targeting spacers) and FIG. 3C (for non-targeting spacers). Regarding FIG. 3B, the results of the MS2 interference screen are shown as box plots. Enrichment of DisCas7-11 spacers in the phage targeting condition denote survival of bacteria and enhanced representation of specific active spacers. Boxes denotes 25th and 75th percentiles with the median marked by the middle line. The whiskers are calculated via the Tukey method (1.5 times the inter-quartile range). Outliers are denoted by square symbols. FIG. 3C shows the results of the MS2 interference screen showing enrichment of DisCas7-11a non-targeting spacers across varying phage dilution amounts as box plots. Boxes denotes 25th and 75th percentiles with the median marked by the middle line. The whiskers are calculated via the Tukey method (1.5 times the inter-quartile range). Outliers are denoted by square symbols.

Figure 3D:
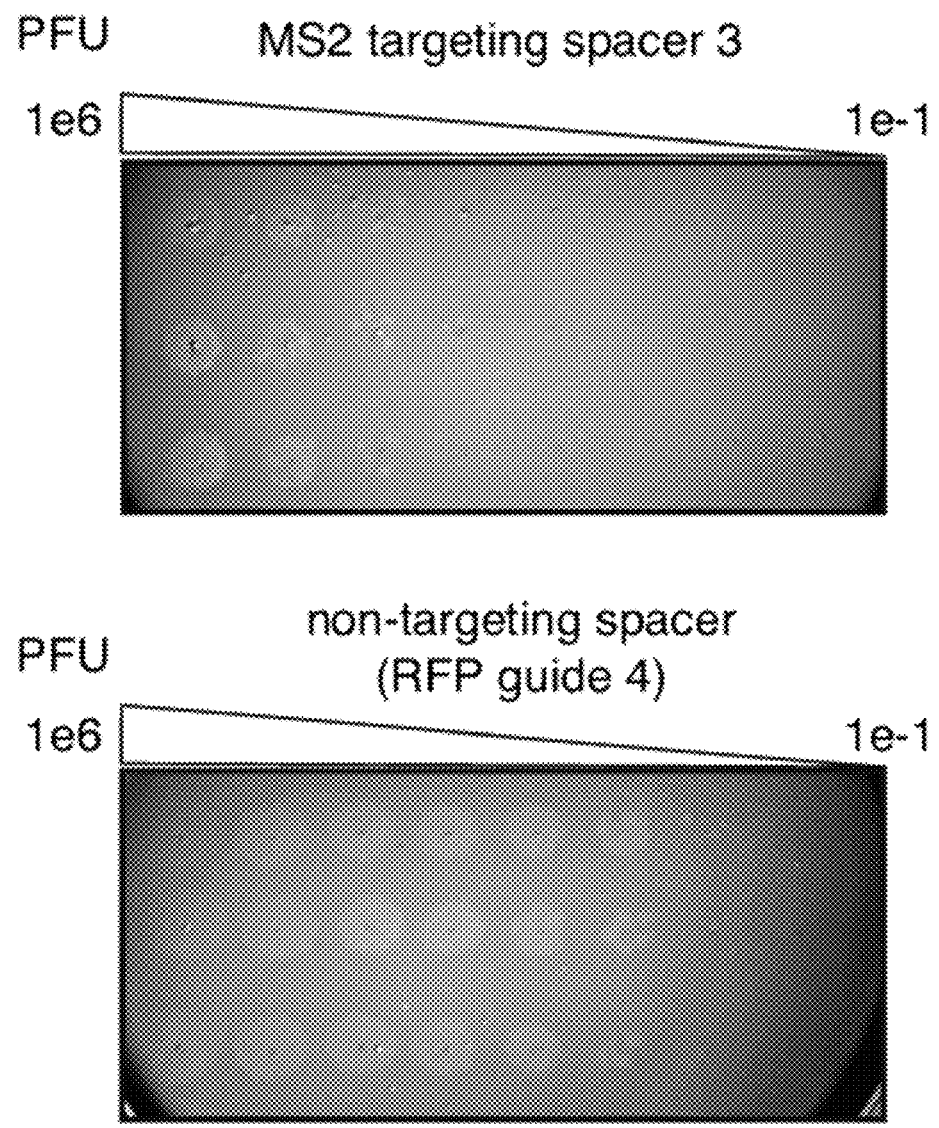
FIG. 3D are images of plaque dilution assays for MS2 targeting spacer and non-targeting spacer according to embodiments of the present teachings.

The enrichment of DisCas7-11 crRNAs in the phage targeting condition denotes the survival of bacteria and enhanced representation of specific active crRNAs. The results of the MS plaque dilution assay are shown in FIG. 3D. The assay shows significant survival of *E. coli* containing the top crRNA identified in the MS2 screen. In the non-targeting spacer, dilutions of phage up to 1e9 are capable of lysing bacteria. For the top targeting spacer, only dilutions up to 1e4 are capable of lysis because of DisCas7-11 interference.

Figure 3E:
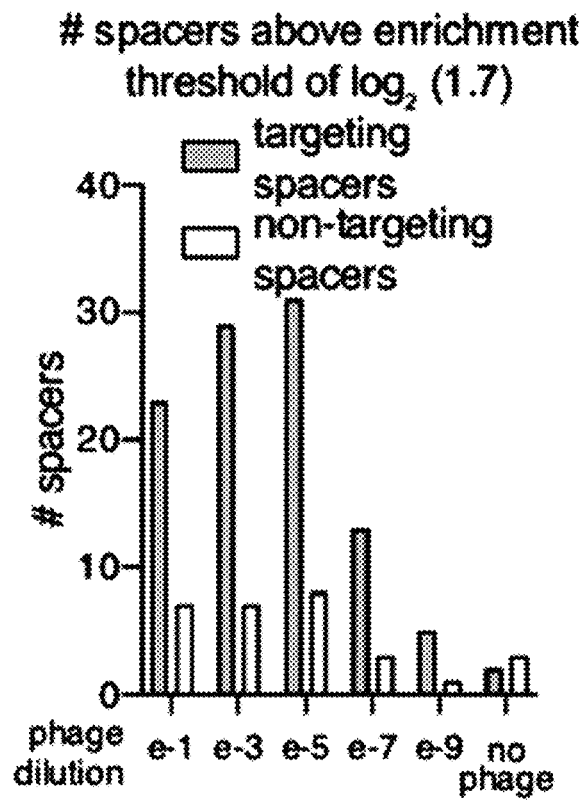
FIG. 3E is a diagram of the number of DisCas7-11a spacers that display survival enrichment over a threshold of 1.7 across different phage dilution conditions according to embodiments of the present teachings.
Figure 3F:
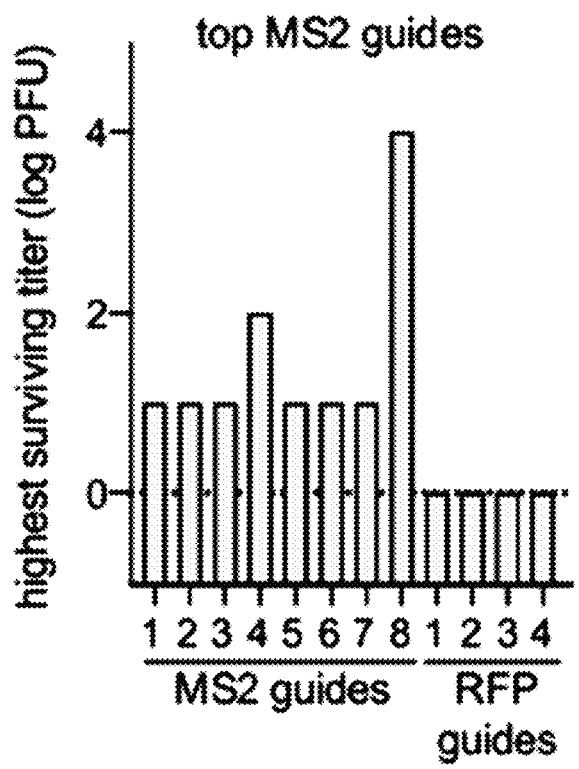
FIG. 3F is a diagram showing Quantification of resistance conferred by top MS2-targeting DisCas7-11 spacers compared against a panel of 4 non-targeting spacers according to embodiments of the present teachings.

The number of DisCas7-11a spacers that display survival enrichment over a threshold of 1.7 across different phage dilution conditions are shown in FIG. 3E. The quantification of resistance conferred by top MS2-targeting DisCas7-11 spacers compared against a panel of 4 non-targeting spacers is shown in FIG. 3F. The resistance is quantified as the highest surviving titer of MS2 phage that generates plaques in the dilution assay.

Figure 3G:
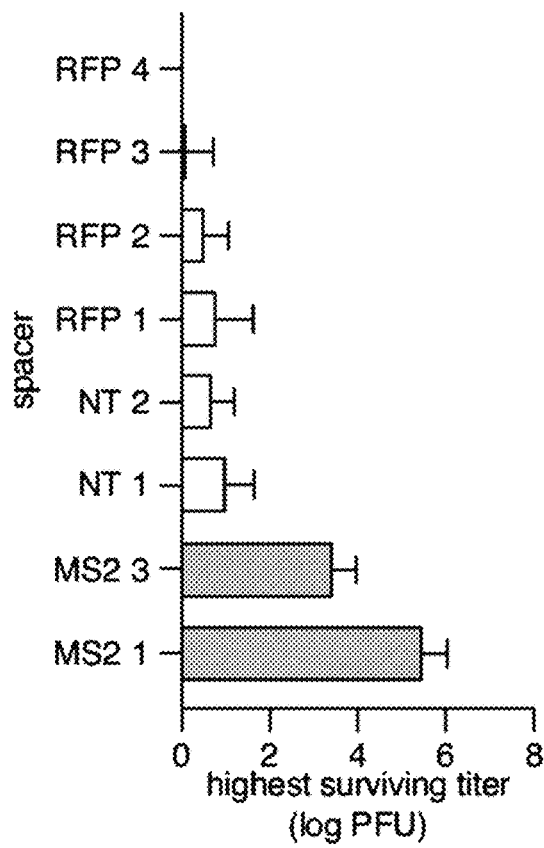
FIG. 3G is a diagram showing the quantification of resistance conferred by two MS2-targeting DisCas7-11 spacers compared against a panel of 6 non-targeting spacers according to embodiments of the present teachings.

The quantification of resistance conferred by two MS2-targeting DisCas7-11 spacers compared against a panel of 6 non-targeting spacers is shown in FIG. 3G. Resistance is quantified as the final dilution of MS2 phage that generates plaques in the dilution assay.

Figure 3H:
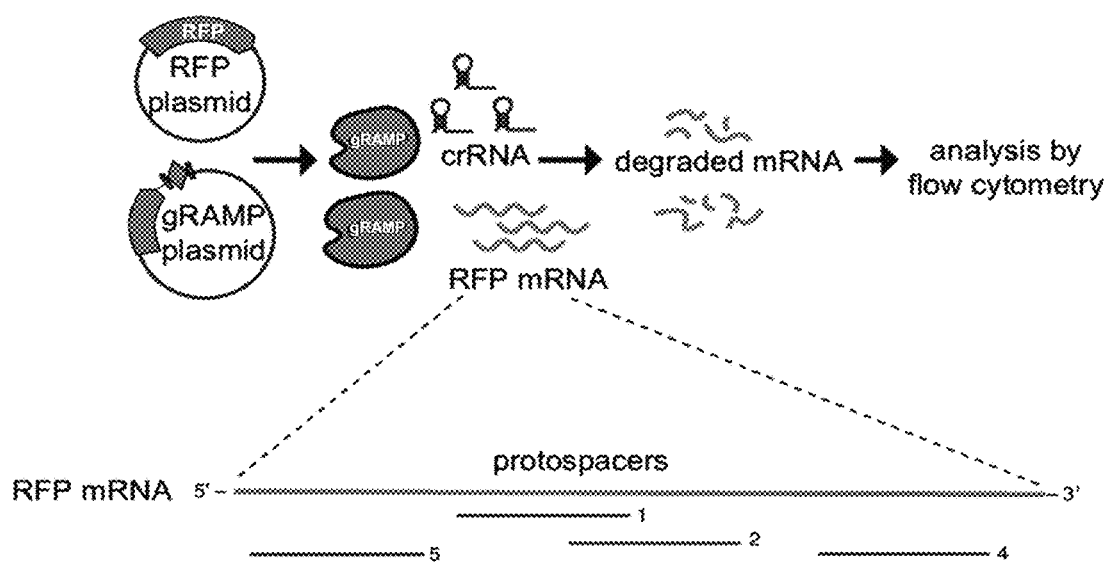
FIG. 3H illustrates the RFP knockdown assay containing a DisCas7-11 and spacers expression vector co-transformed with an RFP-expressing vector according to embodiments of the present teachings.
Figure 3K:
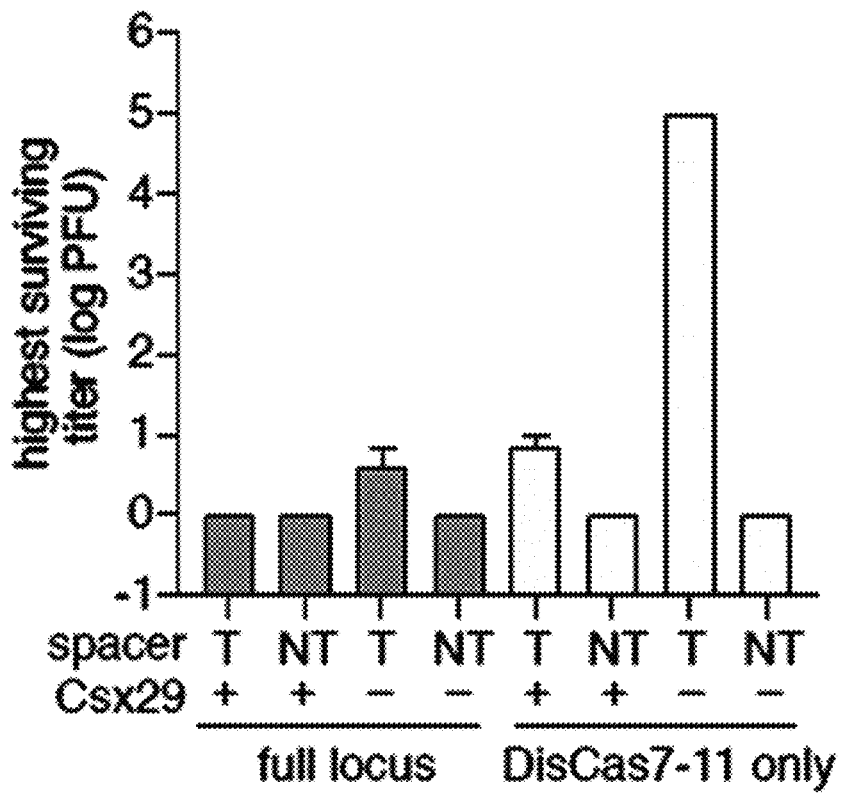
FIG. 3K is a diagram of the MS2 interference activity of DisCas7-1 lain the full locus and as a single effector with and without Csx29 expression according to embodiments of the present teachings.

The RFP knockdown assay containing a DisCas7-11 and spacers expression vector co-transformed with an RFP-expressing vector is illustrated in FIG. 3H, and the results from the knockdown assay are shown in FIG. 3I. The RFP knockdown assay by multiple targeting spacers is normalized to a non-targeting condition as determined by flow cytometry. DisCas7-11-mediate RFP knockdown was found to exceed 50%.

The DisCas7-11a full locus with TPR-CHAT nearby and DisCas7-11a effector expressed alone with TPR-CHAT are illustrated in FIG. 3H, and the MS2 interference activity of DisCas7-11a in the full locus and as a single effector with and without TPR-CHAT expression is shown in FIG. 3I.

Example 3

Cas7-11 Cleavage Activity

Figure 4A:
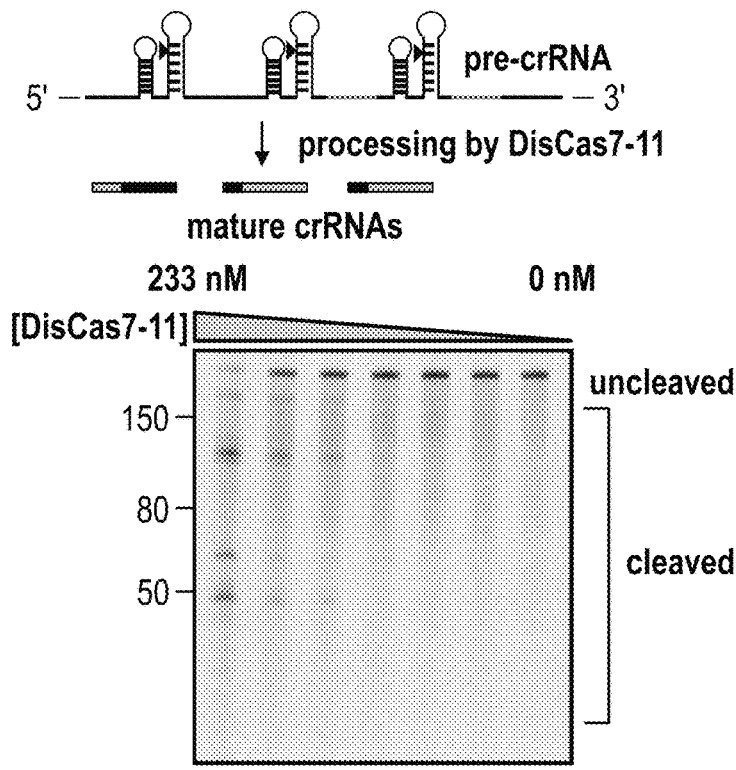
FIG. 4A illustrates a CRISPR array processing assay for DisCas7-11 according to embodiments of the present teachings.
Figure 4B:
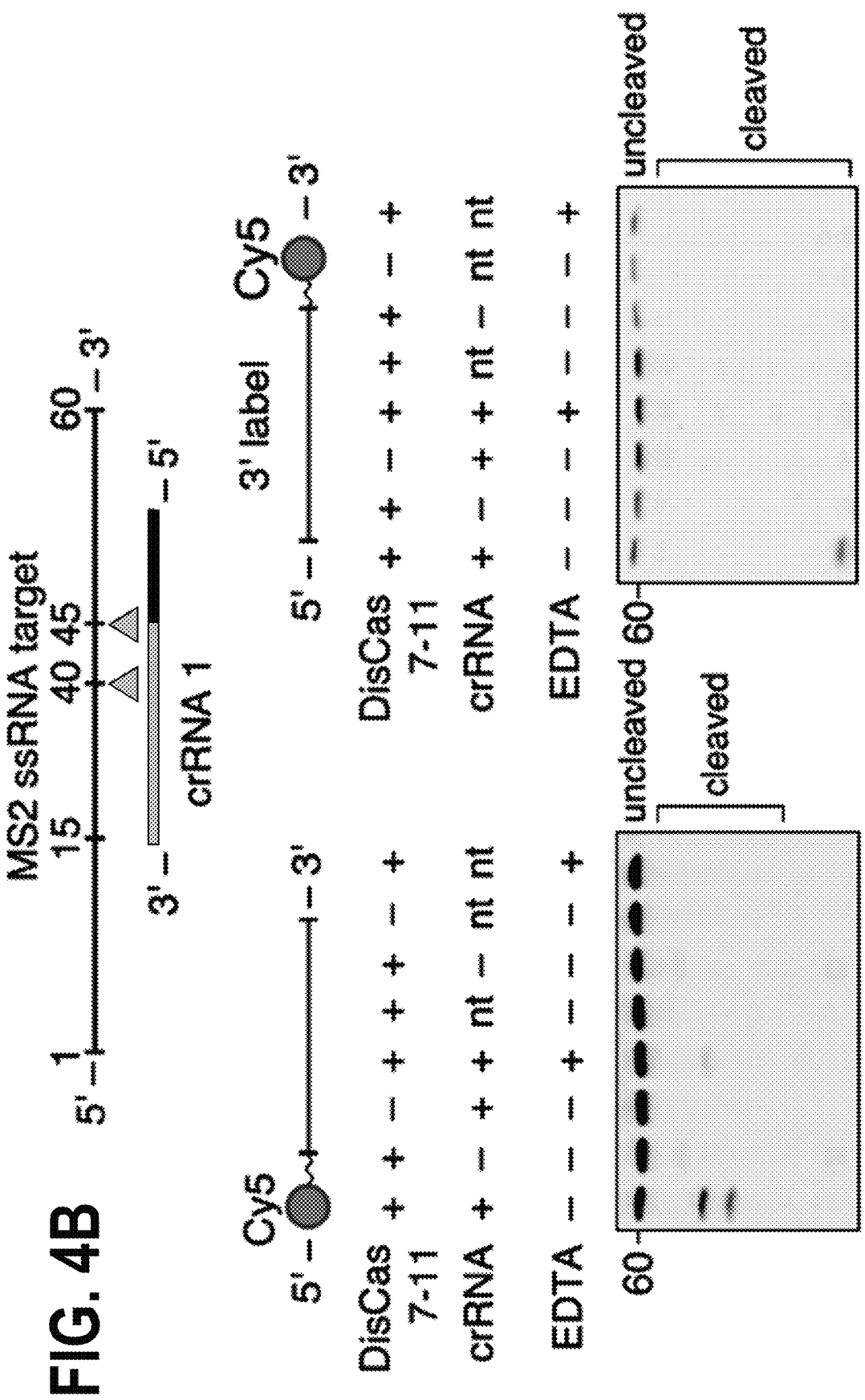
FIG. 4B illustrates the in vitori cleavage of ssRNA 1 target according to embodiments of the present teachings.
Figure 4C:
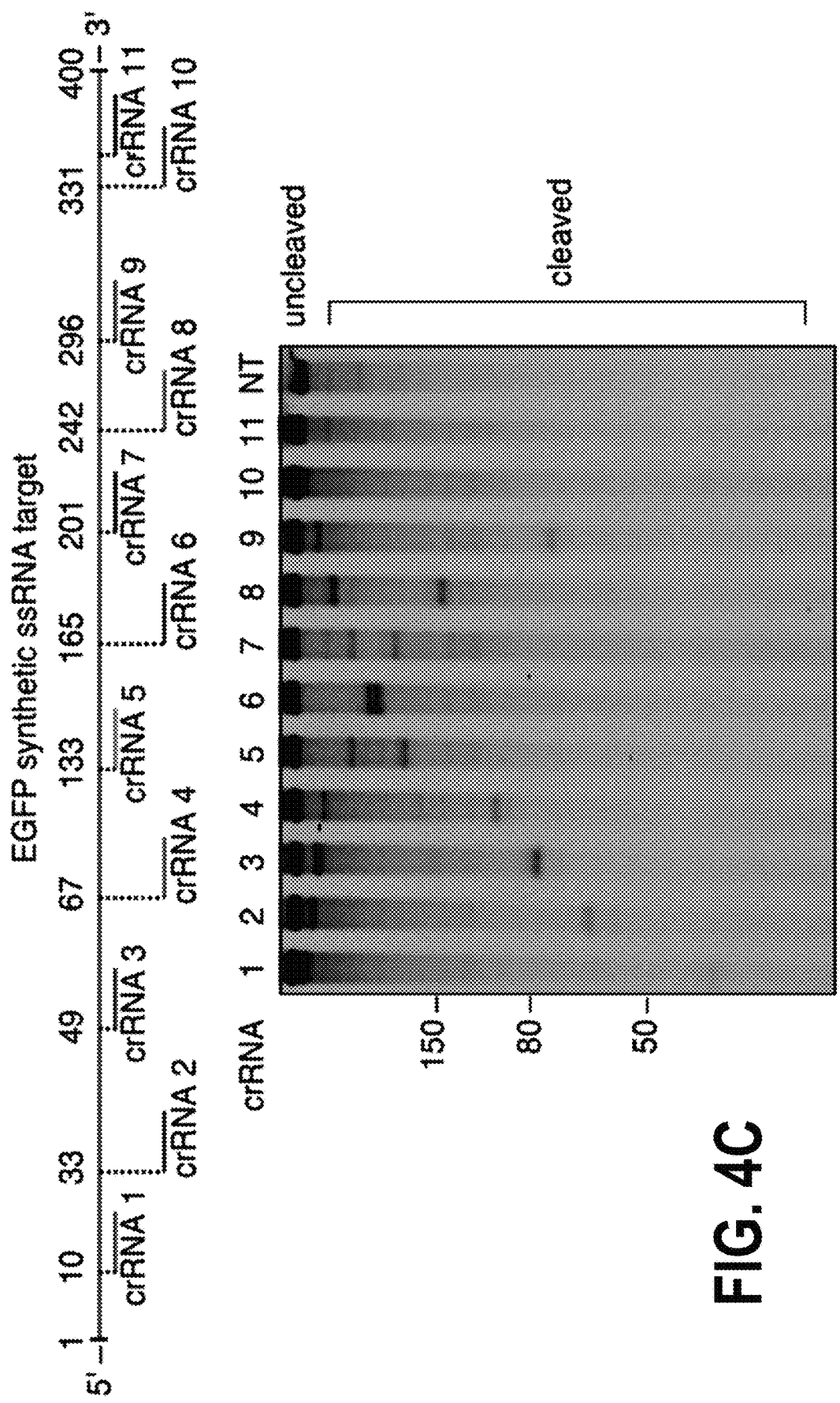
FIG. 4C illustrates the cleavage of EGFP ssRNA at multiple sites with tiled crRNAs according to embodiments of the present teachings.
Figure 4D:
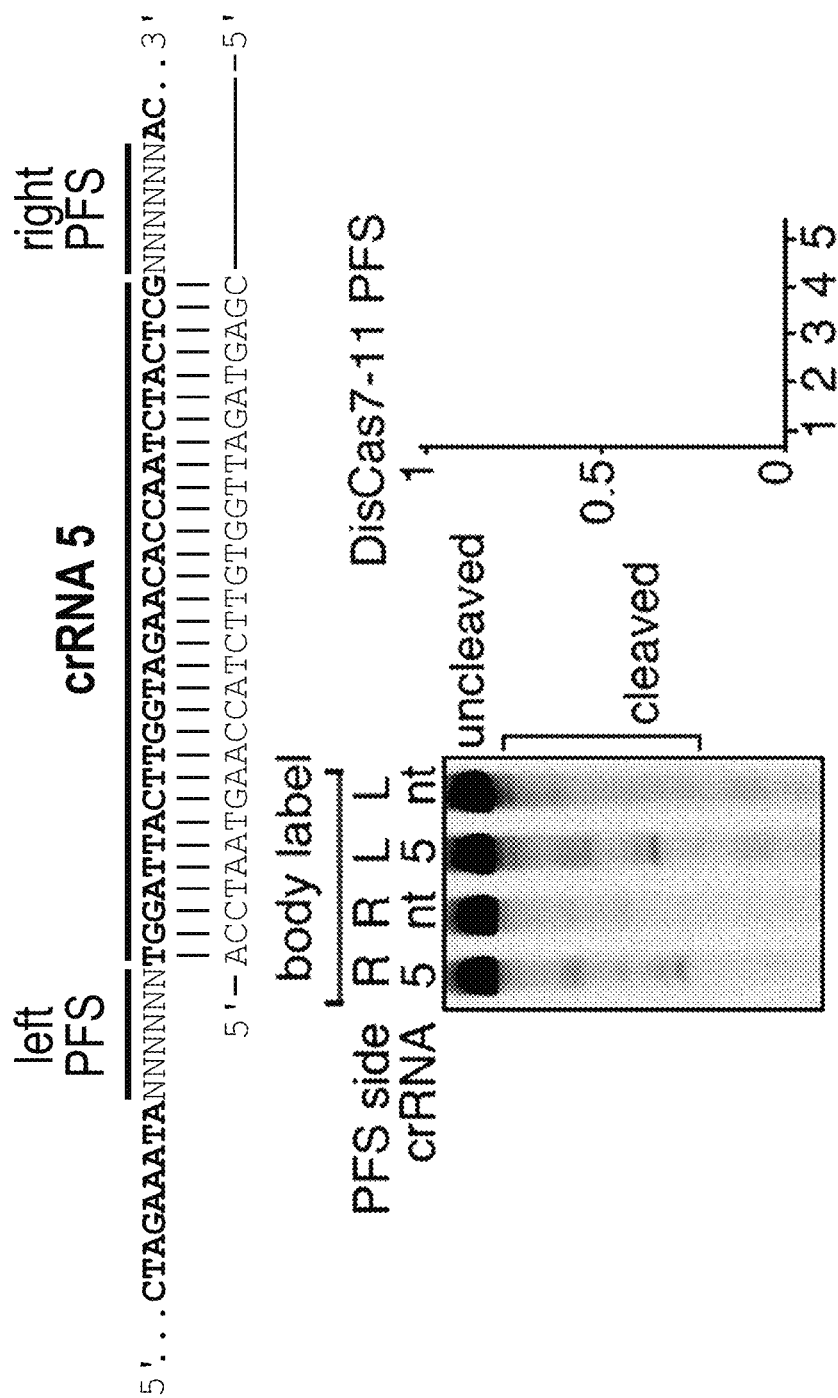
FIG. 4D illustrates the protospacer flanking site (PFS) sequence screen showing in vitro cleavage of randomized PFS targets and lack of sequence preference flanking the target site for DisCas7-11 cleavage according to embodiments of the present teachings. Figure discloses SEQ ID NOS 635-636, respectively, in order of appearance.
Figure 4E:
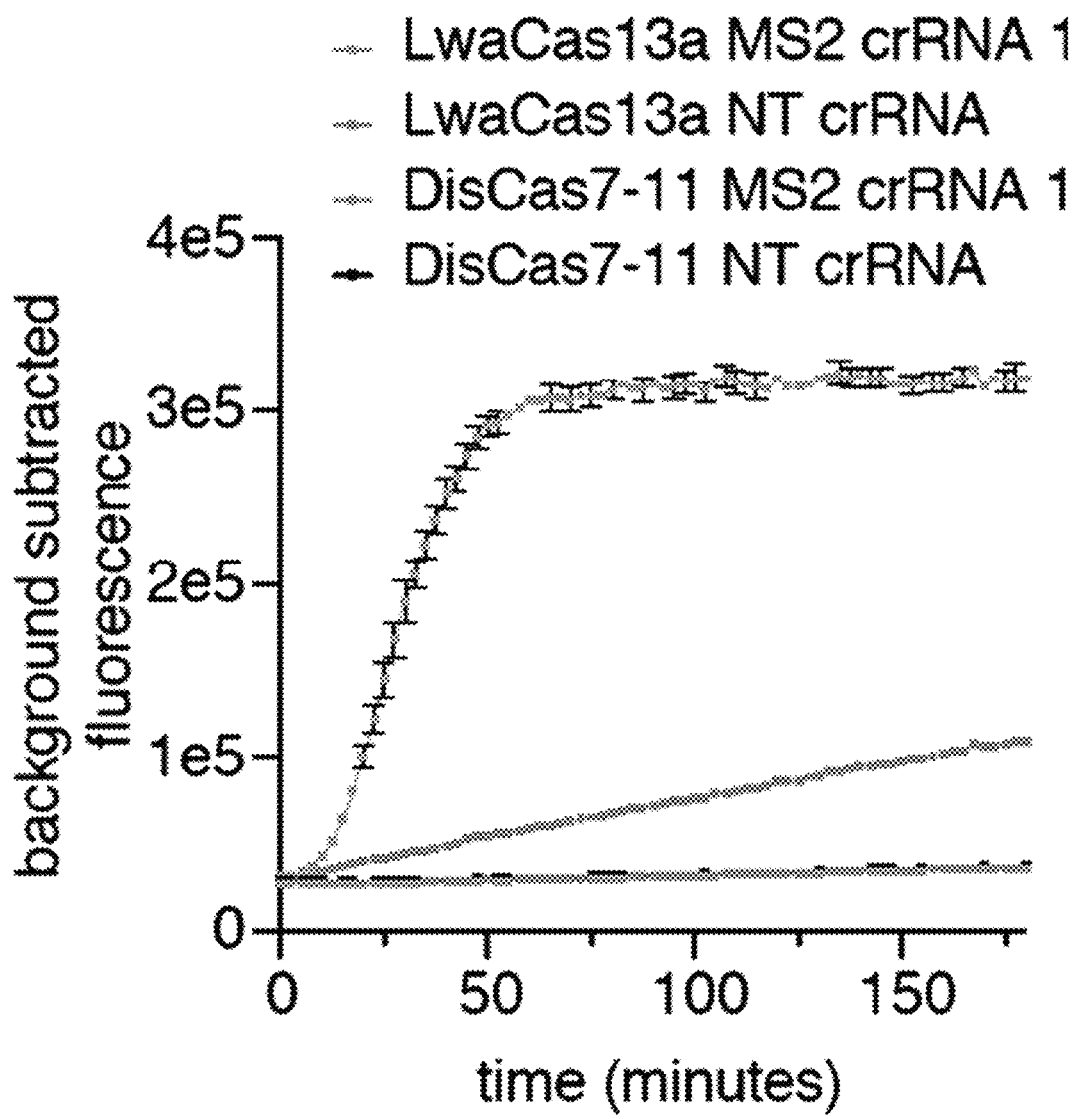
FIG. 4E is a diagram of the kinetics of fluorescence due to RnaseAlert collateral cleavage by DisCas7-11 or LwaCas13a targeting and non-targeting guides against the MS2 RNA target according to embodiments of the present teachings.
Figure 4F:
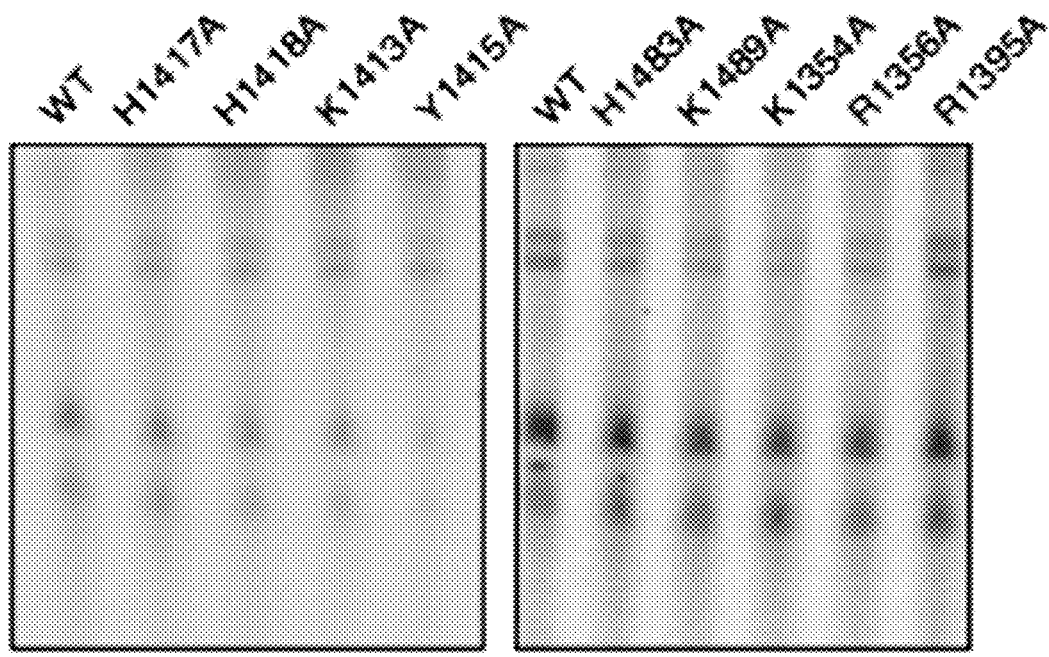
FIG. 4F illustrates the processing activity of a synthetic DisCas7-11 CRISPR array by DisCas7-11 protein with predicted catalytic processing mutants in the protein insert region with a characteristic K×Y×H catalytic according to embodiments of the present teachings.
Figure 4G:
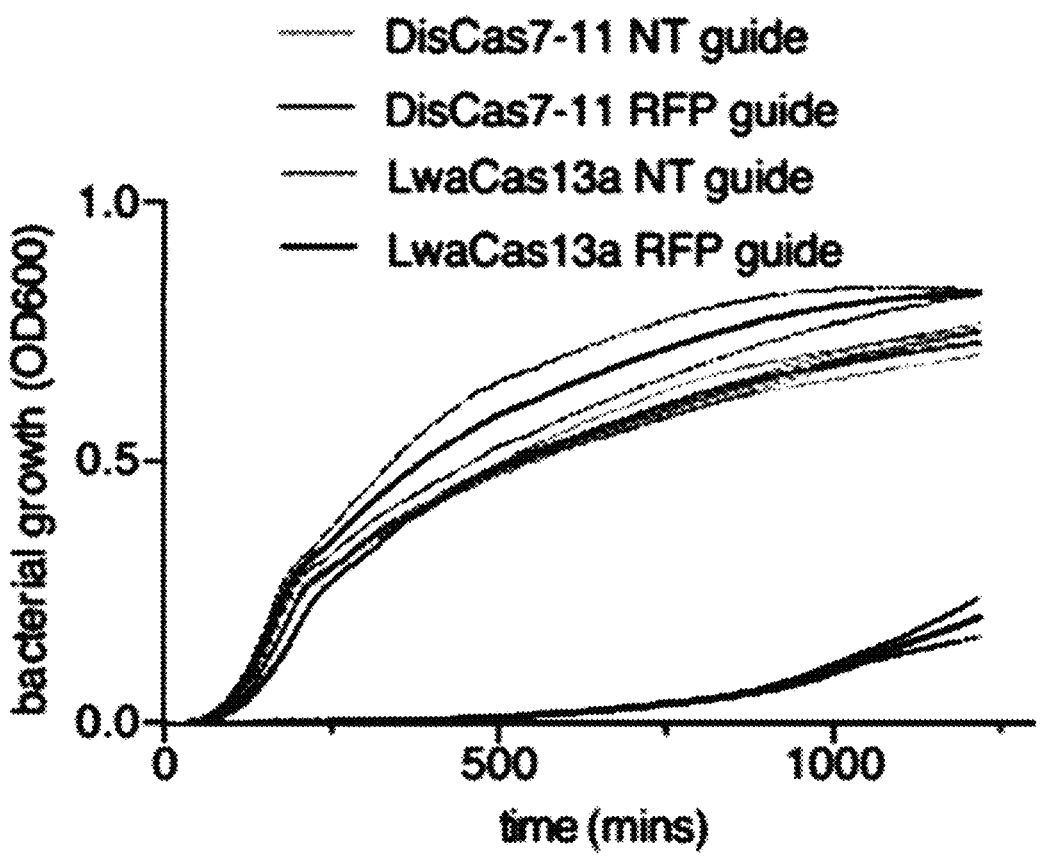
FIG. 4G is the graph showing the measurement of bacterial growth (OD600) during target interference by DisCas7-11 and LwaCas13 according to embodiments of the present teachings.

The DisCas7-11 programmable RNA cleavage activity was biochemically characterized. The CRISPR array processing assay for DisCas7-11 is illustrated in FIG. 4A and shows robust processing activity by DisCas7-11. The DisCas7-11 was assayed at concentrations ranging between 0 nM and 233 nM. The in vitori cleavage of ssRNA 1 target is illustrated in FIG. 4B and demonstrates that programmable DisCas7-11 RNA targeting is Mg+2 and crRNA dependent. Note that the targets are either 5' or 3' fluorescently labeled. The results from the cleavage of EGFP ssRNA at multiple sites with tiled crRNAs are shown in FIG. 4C. A varying cleavage pattern based on target position is observed. The protospacer flanking site (PFS) sequence screen is illustrated in FIG. 4D and shows a varying cleavage pattern based on target position and a lack of sequence preference flanking the target site for DisCas7-11 cleavage. The kinetics of fluorescence due to RnaseAlert collateral cleavage by DisCas7-11 or LwaCas13a targeting and non-targeting crRNA against the MS2 RNA target are illustrated in FIG. 4E. The processing activity of a synthetic DisCas7-11 CRISPR array by DisCas7-11 protein with predicted catalytic processing mutants in the protein insert region with a characteristic K×Y×H catalytic triad motif is illustrated in FIG. 4F. The measurement of bacterial growth (OD600) during target interference by DisCas7-11 and LwaCas13 is shown in FIG. 4G.

Example 4

Cas7-11 Catalytic Residues

The catalytic residues in DisCas7-11 were identified.

Figure 5A:
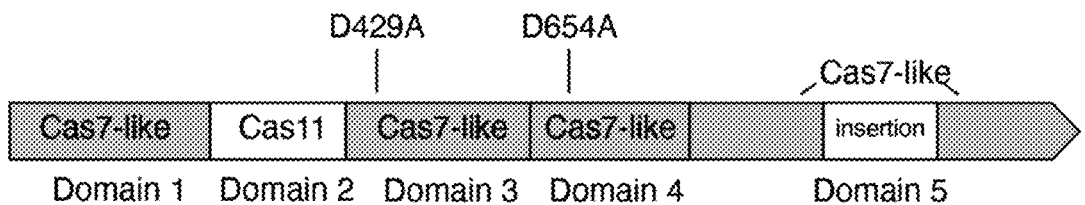
FIG. 5A is a schematic of the protein domains of DisCas7-11 with putative catalytic residues highlighted in Cas7-like domains 3 and 4 according to embodiments of the present teachings.
Figure 5B:
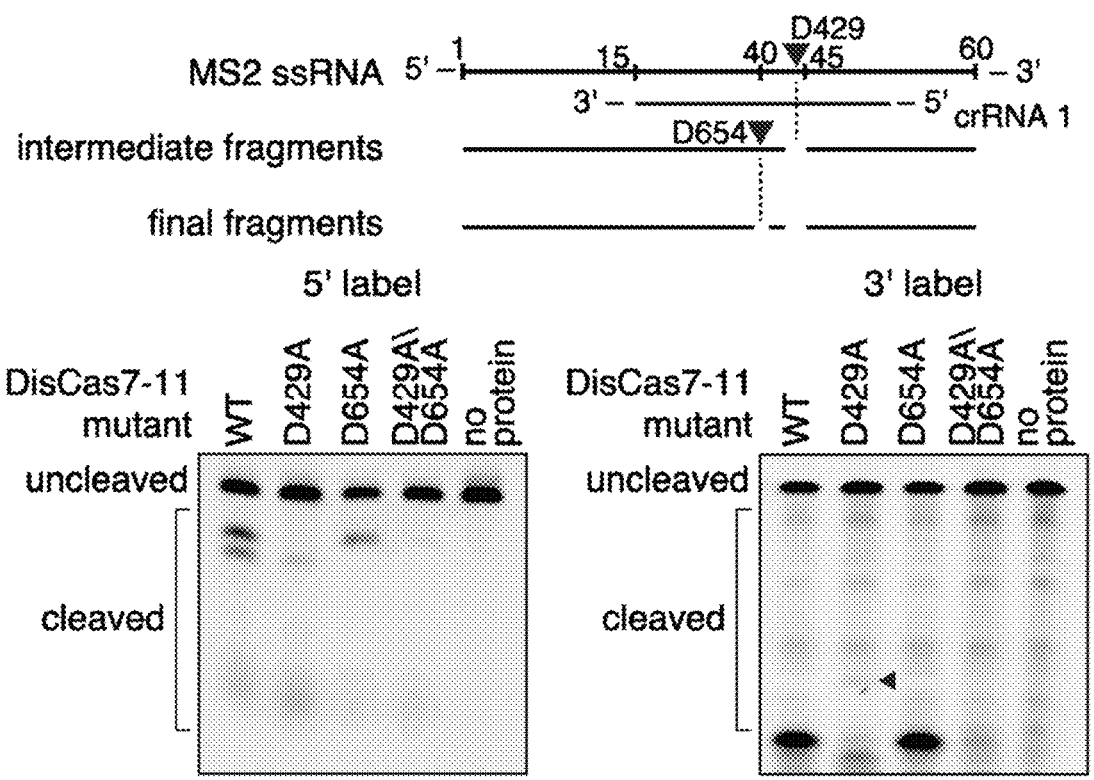
FIG. 5B illustrates that the cleavage of synthetic ssRNA target with two cRNAs and wild type, D429A, D654A, and D429A/D654A DisCas7-11 proteins according to embodiments of the present teachings.
Figure 5C:
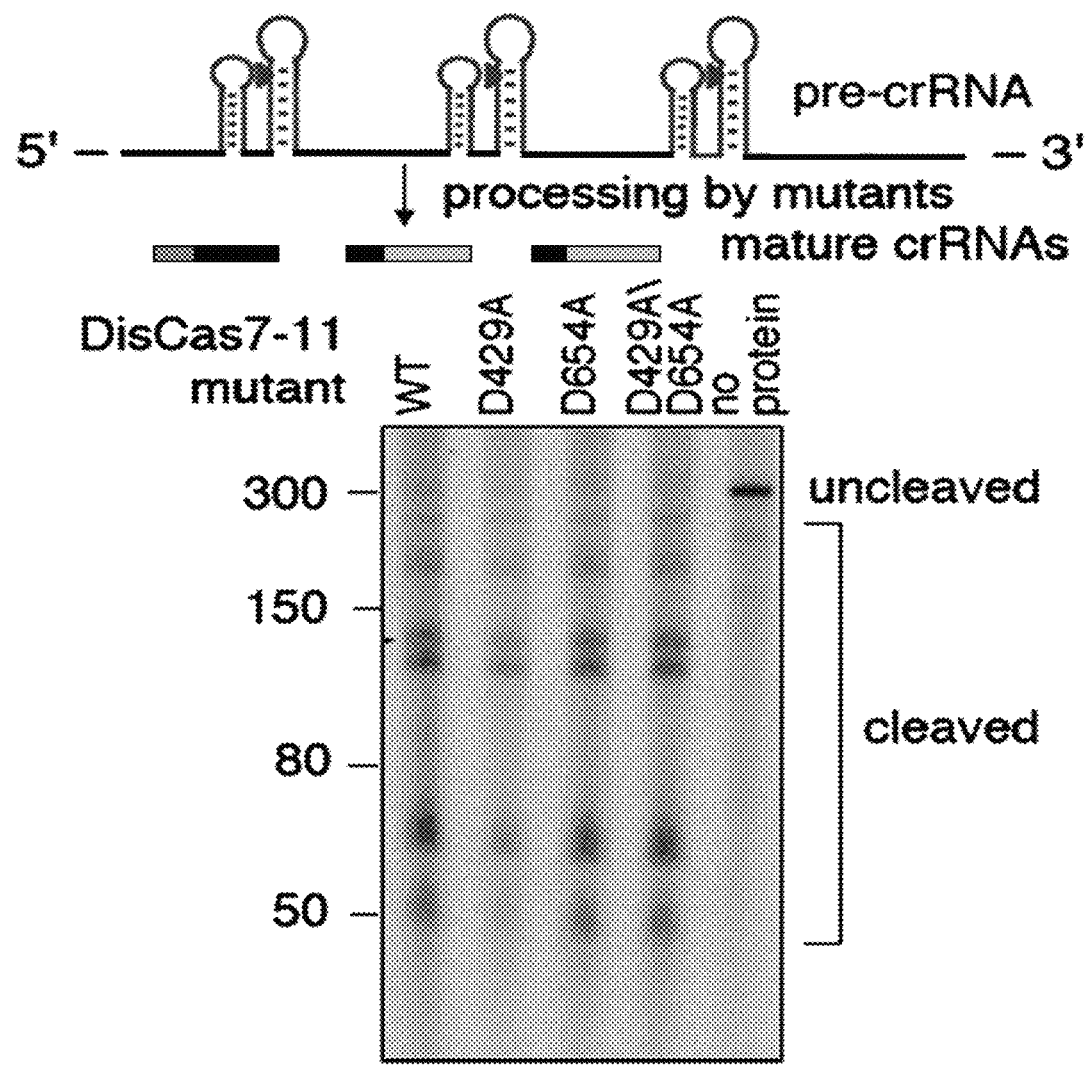
FIG. 5C illustrates the processing of a synthetic DisCas7-11 CRISPR array by catalytic DisCas7-11 mutants according to embodiments of the present teachings.
Figure 5D:
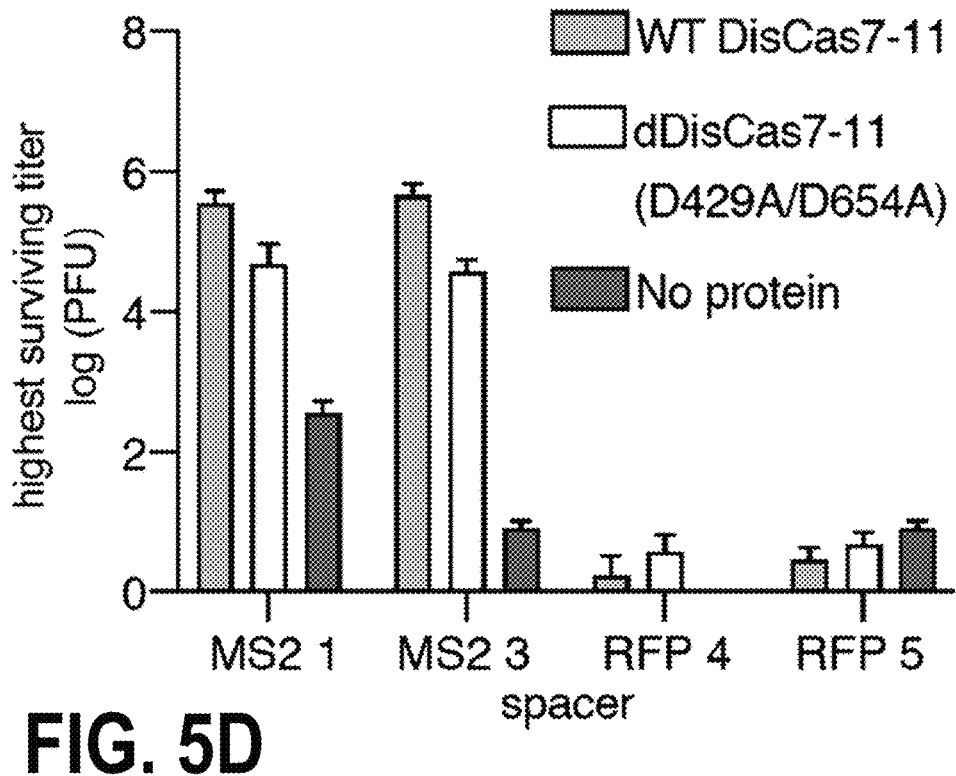
FIG. 5D is a diagram showing the MS2 phage interference in bacteria according to embodiments of the present teachings.
Figure 5E:
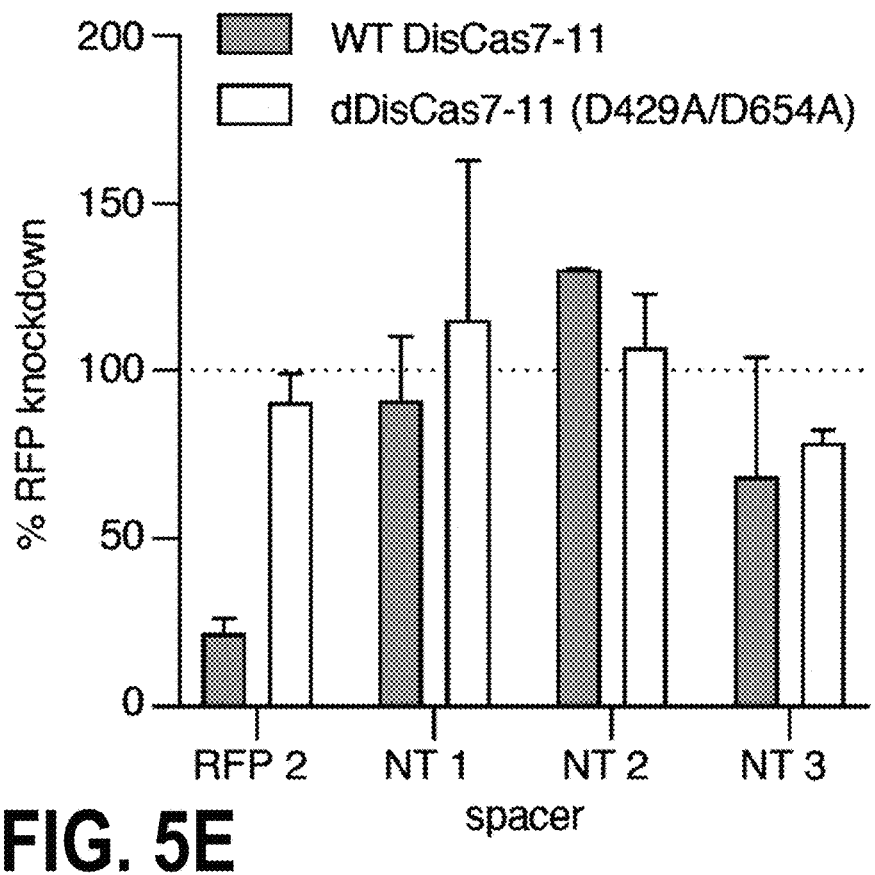
FIG. 5E is a diagram showing the RFP knockdown in E. coli that is prevented by the catalytic mutation D429A/D654A in DisCas7-11 according to embodiments of the present teachings.

The protein domains of DisCas7-11 with putative catalytic residues highlighted in Cas7-like domains 3 and 4 are illustrated in FIG. 5A. The results from the cleavage of synthetic ssRNA target with two cRNAs and wild type, D429A, D654A, and D429A/D654A DisCas7-11 proteins are shown in FIG. 5B. The cleavage is affected by the single mutants and completely inactivated by the double mutant D429A/D654A. The processing of a synthetic DisCas7-11 CRISPR array by catalytic DisCas7-11 mutants is not affected by D429A and D654A catalytic mutations (FIG. 5C). The MS2 phage interference in bacteria is affected by D429A/D654A mutations, although there is remaining residual interference above the lack of DisCas7-11 altogether (FIG. 5D). The RFP knockdown in *E. coli* is prevented by the catalytic mutation D429A/D654A in DisCas7-11 (FIG. 5E).

Figure 5F:
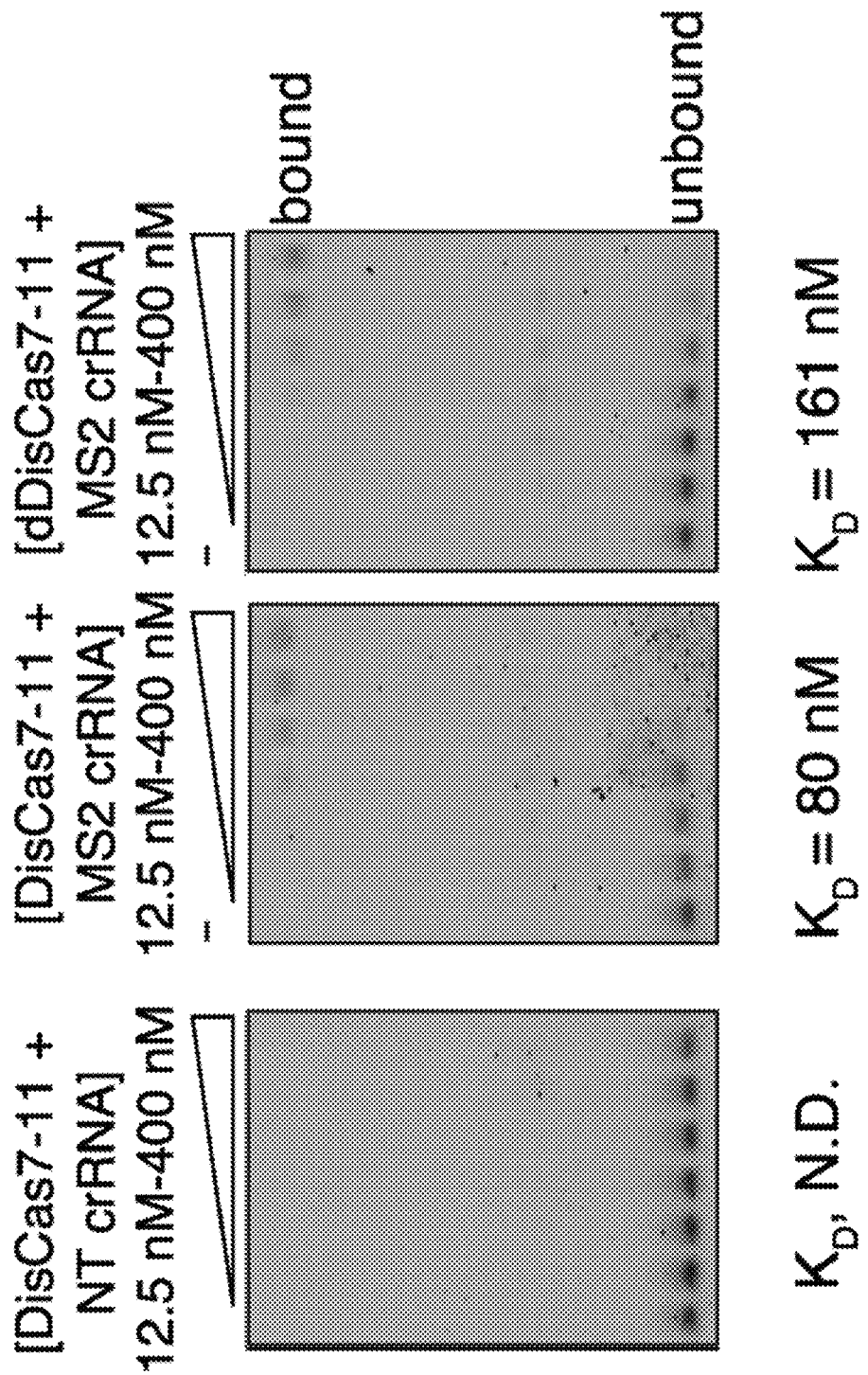
FIG. 5F illustrates the DisCas7-11:crRNA complex binding to a complementary MS2 ssRNA target that is determined by electrophoretic mobility shift assay (EMSA) according to embodiments of the present teachings.

The DisCas7-11:crRNA complex binding to a complementary MS2 ssRNA target is determined by electrophoretic mobility shift assay (EMSA) and illustrated in FIG. 5F. An EMSA is performed for both the WT DisCas7-11 and dead DisCas7-11 complexes and is compared to WT DisCas7-11 in complex with a non-targeting crRNA. The Kd value for the WT and dead DisCas7-11 complexes are shown below corresponding gels.

Example 5

Cas7-11 Cleavage Sites

Figure 6A:
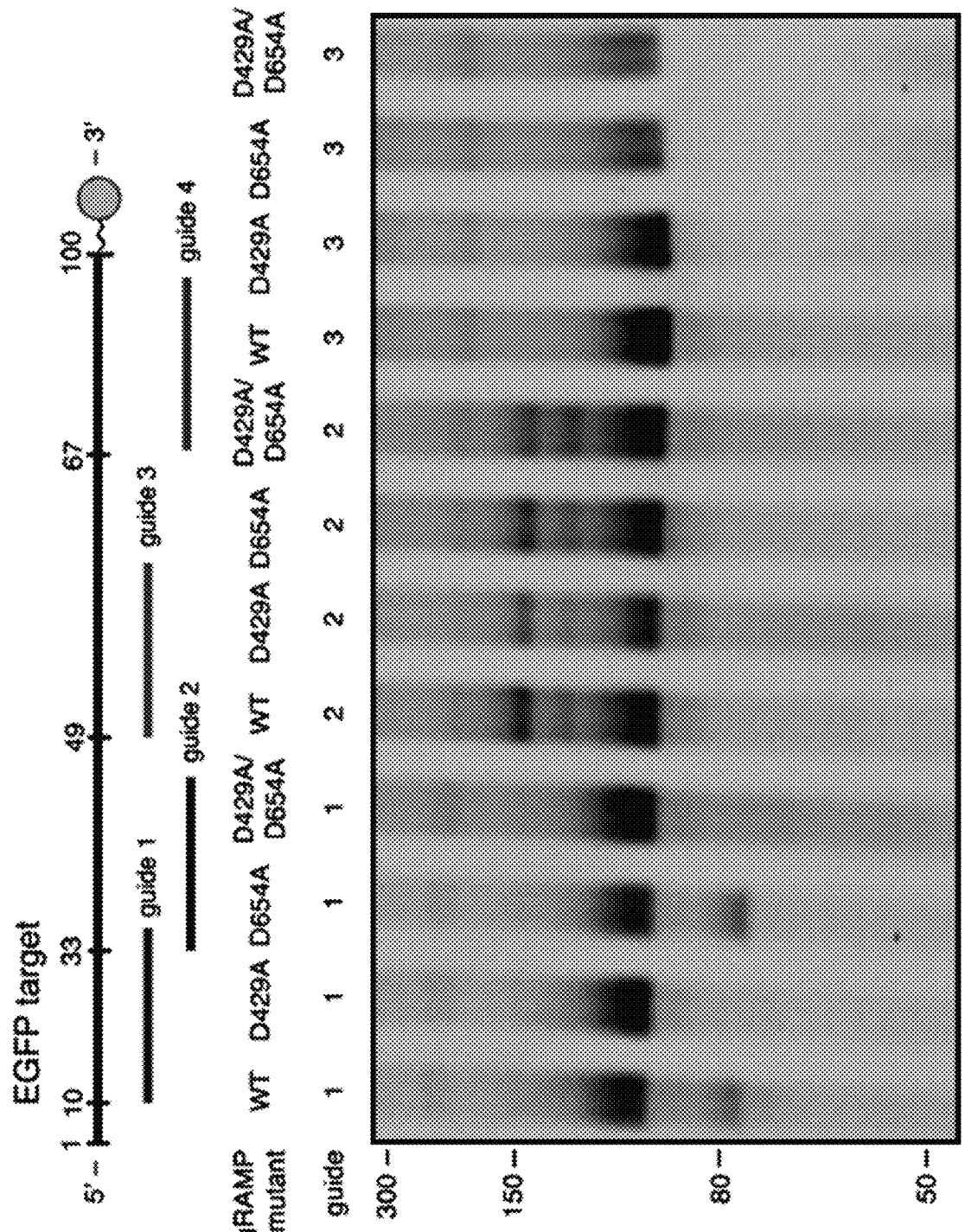
FIG. 6A illustrates DisCas7-11 guides targeting multiple sites on a synthetic 100 nt EGFP ssRNA according to embodiments of the present teachings.
Figure 6B:
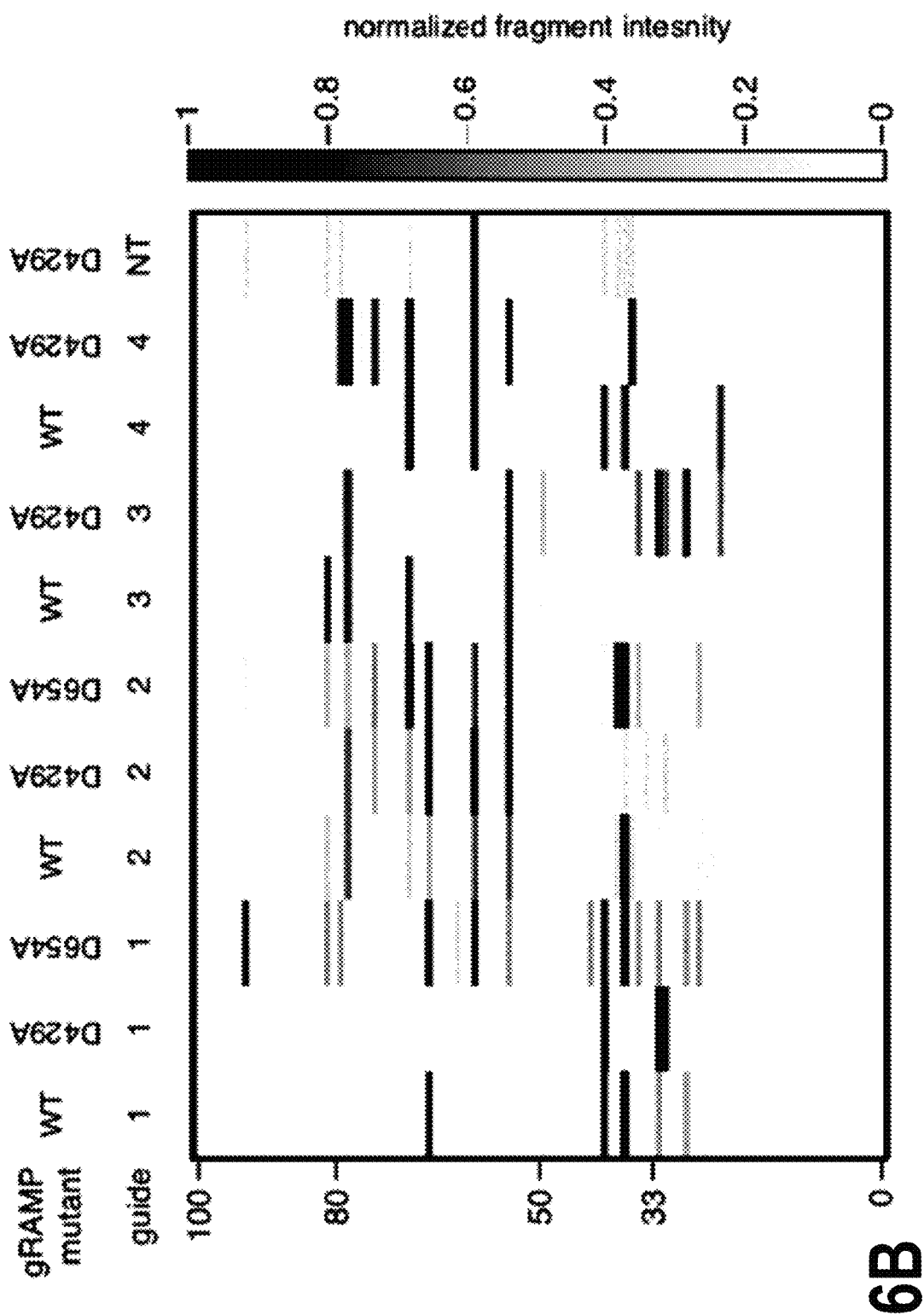
FIG. 6B are images of cleavage patterns of each EGFP-targeting guide incubated with DisCas7-11 on a 3' labeled EGFP ssRNA according to embodiments of the present teachings.
Figure 6C:
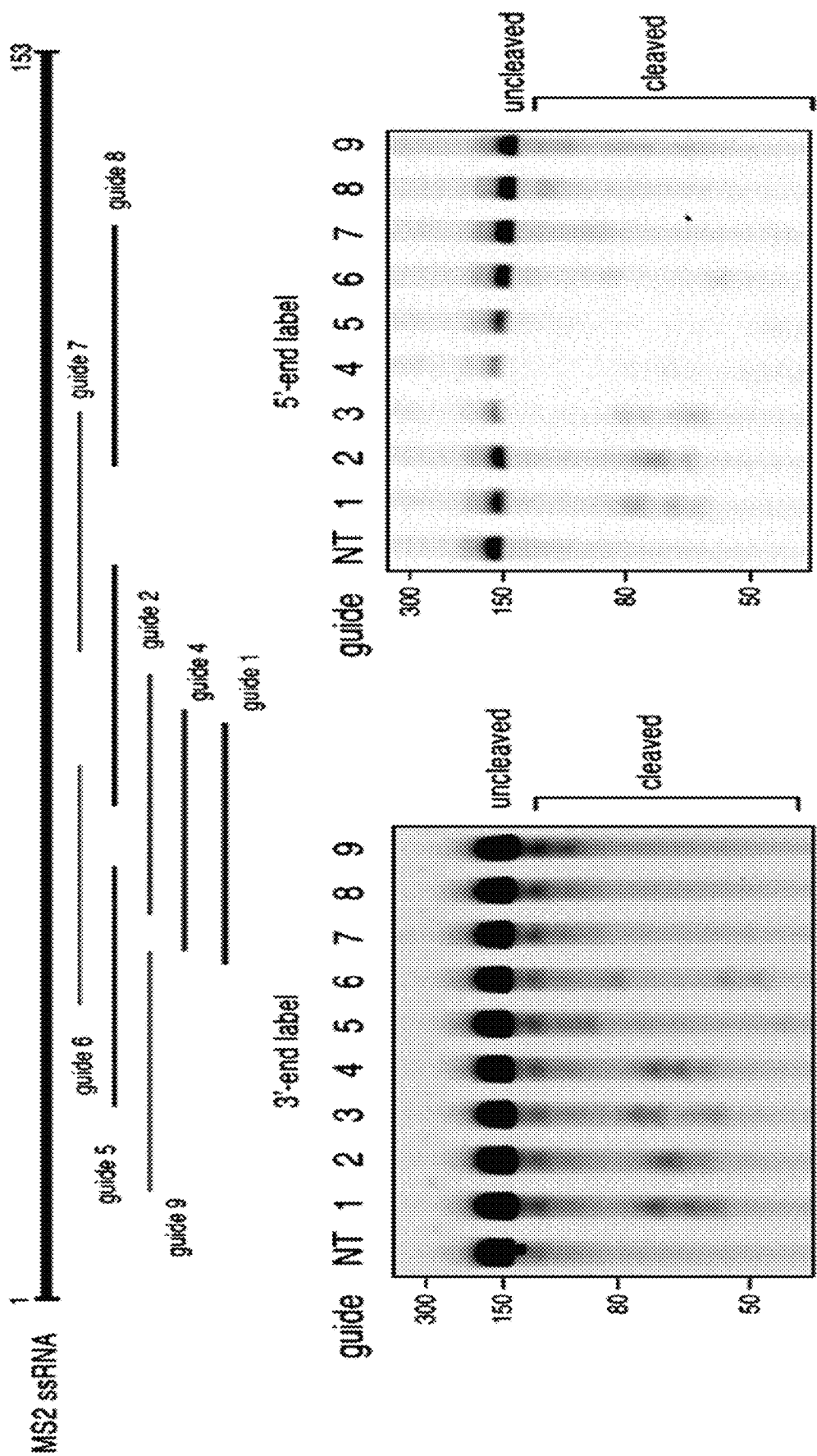
FIG. 6C illustrates DisCas7-11 that is incubated with a panel of crRNAs targeting either MS2 ssRNA or ssRNA target 2, two targets of equivalent length (153 nt) according to embodiments of the present teachings.
Figure 6D:
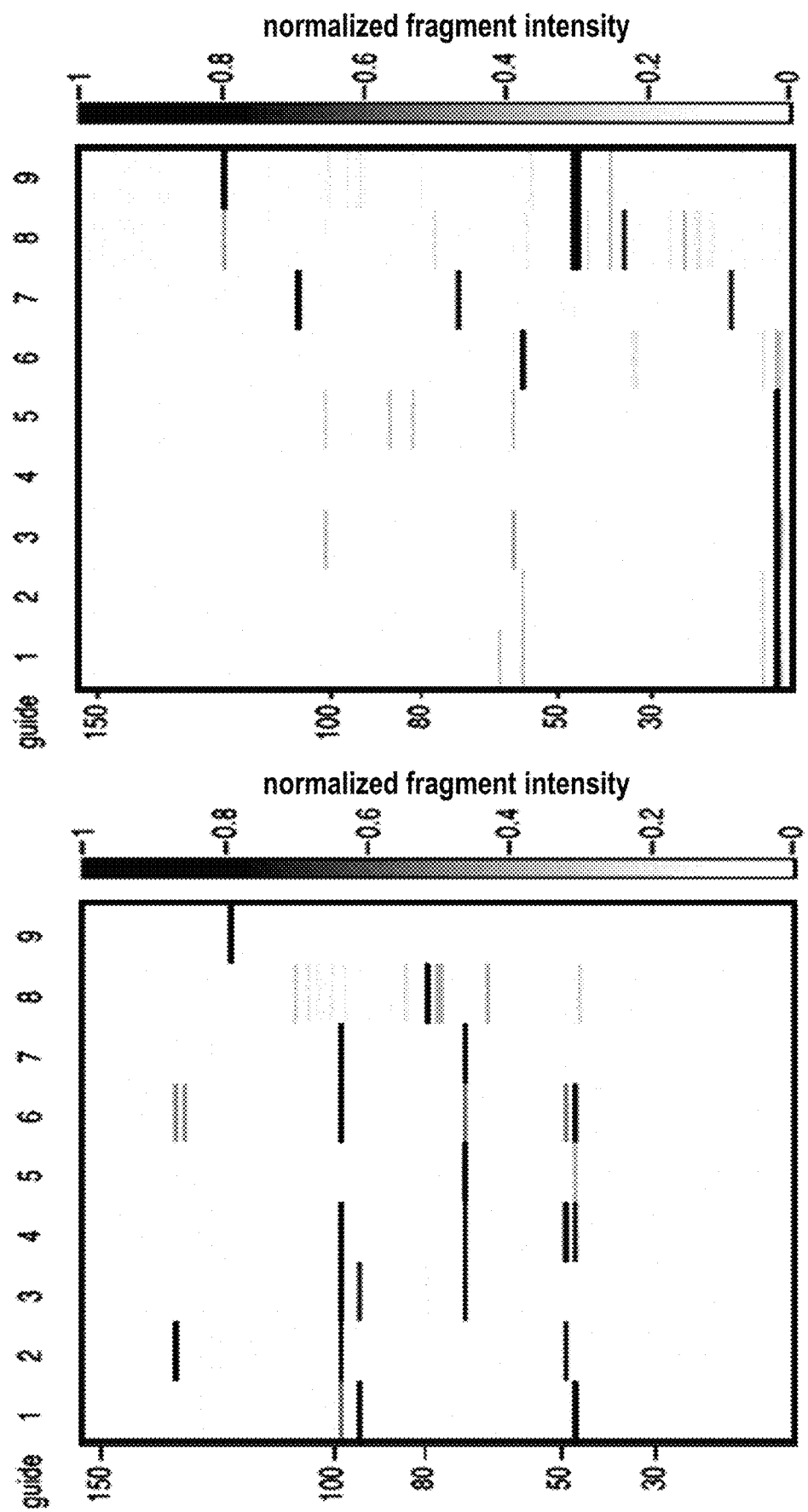
FIG. 6D are images of cleavage patterns of each guide incubated with MS2 ssRNA or ssRNA target 2 according to embodiments of the present teachings.

DisCas7-11 cleavage sites were characterized. The DisCas7-11 guides targeting multiple sites on a synthetic 100 nt EGFP ssRNA target are illustrated in FIG. 6A and the cleavage patterns of each EGFP-targeting guide incubated with DisCas7-11 on a 3' labeled EGFP ssRNA are shown in FIG. 6B. The DisCas7-11 guides targeting of multiple sites on either MS2 ssRNA or ssRNA target 2, two targets of equivalent length (153 nt), are illustrated in in FIG. 6C. The guides are designed to target sites at the same position on both targets in order to better understand whether sequence specific cleavage preferences exist and whether cleavage cut sites are position dependent. The cleavage patterns of each guide incubated with MS2 ssRNA or ssRNA target 2 are shown in FIG. 6D.

Example 6

Cas7-11 Orthologs Activity

The CRISPR processing and RNA cleavage activity were demonstrated for different DisCas7-11 orthologs.

Figures 7A, 7B:
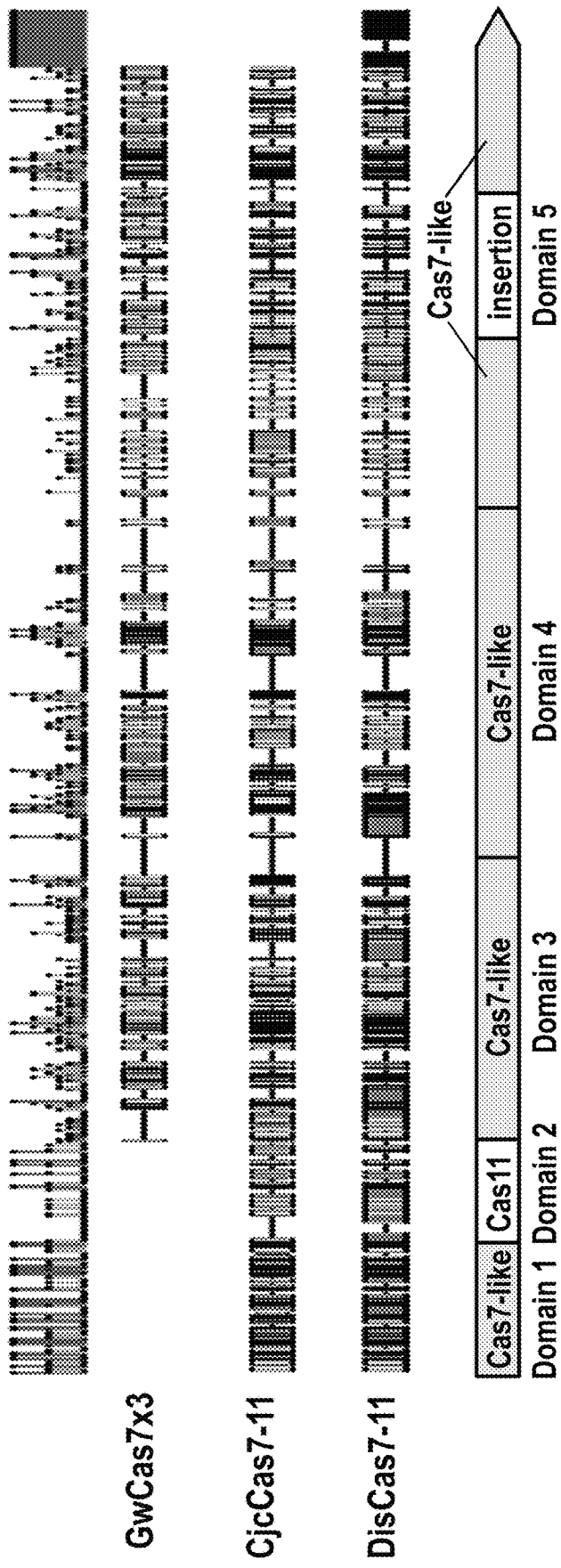
FIG. 7A tbc is a schematic of three Cas7-11 orthologs (GwCas7-11, CjcCas7-11, and DisCas7-11) according to embodiments of the present teachings.
FIG. 7B illustrates multiple sequence alignments of the DR sequences for GwCas7-11, CjcCas7-11, and DisCas7-11 according to embodiments of the present teachings. Figure discloses SEQ ID NOS 637, 638, and 634, respectively, in order of appearance.

The schematics of three Cas7-11 orthologs (GwCas7-11, CjcCas7-11, and DisCas7-11) chosen for additional characterization are shown in FIG. 7A, wherein a multiple sequence alignment of the three orthologs compared against the domain organization of a typical Cas7-11 protein is shown. The multiple sequence alignments of the DR sequences for GwCas7-11, CjcCas7-11, and DisCas7-11 are shown in FIG. 7B. Mismatches against the consensus are highlighted in grey and the grey region shows the sections of the DRs that are cleaved from the pre-crRNAs to generate mature crRNAs.

Figure 7C:
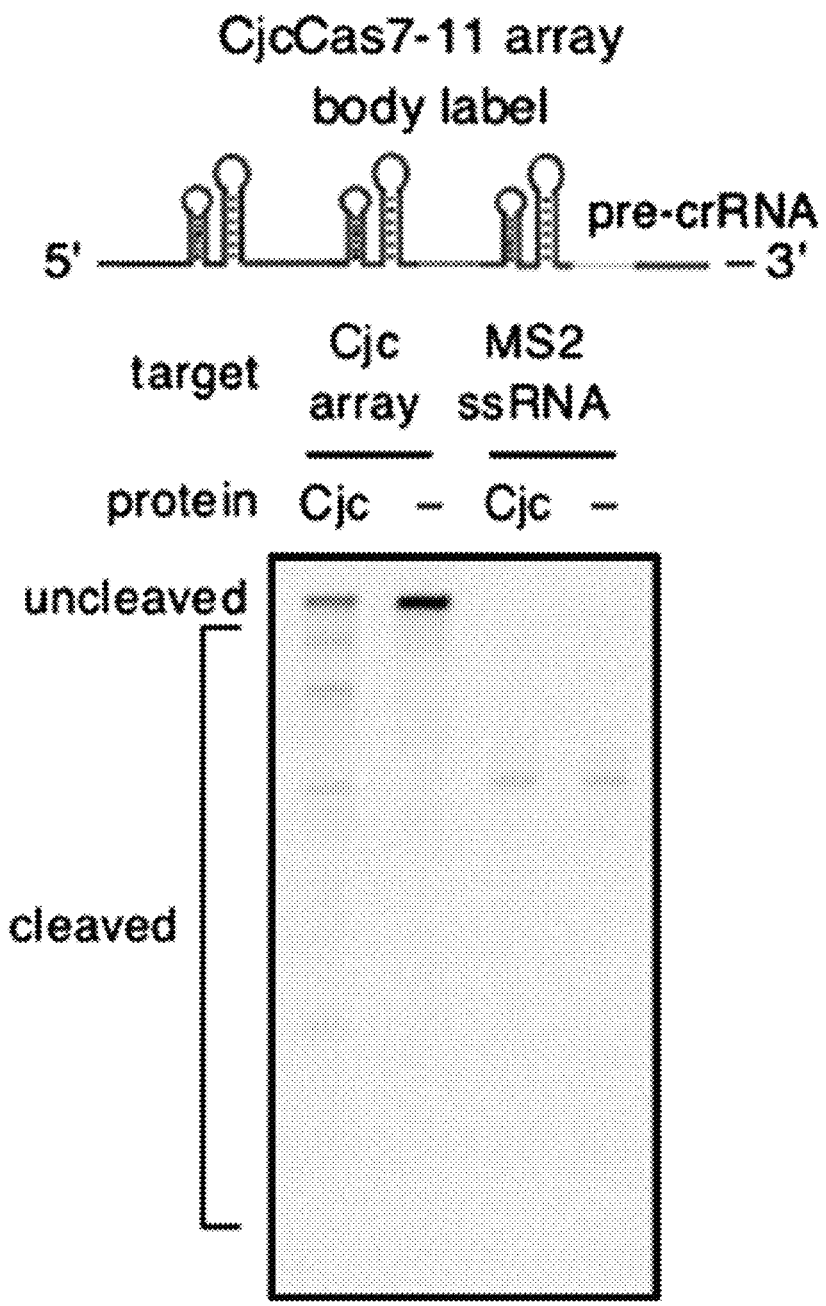
FIG. 7C illustrates the activity of Cas7-11 from Candidatus *Jettenia caeni* (CjcCas7-11) according to embodiments of the present teachings.
Figure 7D:
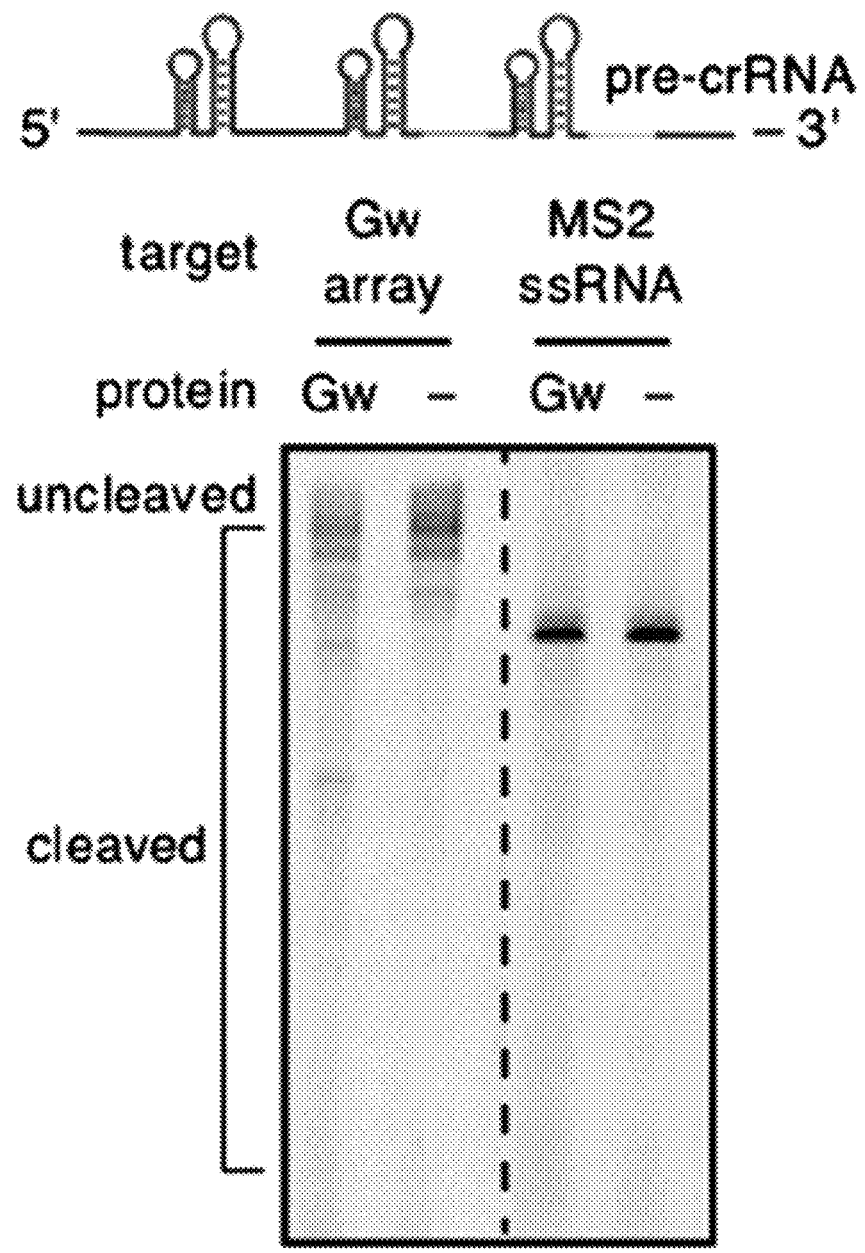
FIG. 7D illustrates the activity of Cas7-11 from groundwater metagenomes (GwCas7-11) according to embodiments of the present teachings.
Figure 7E:
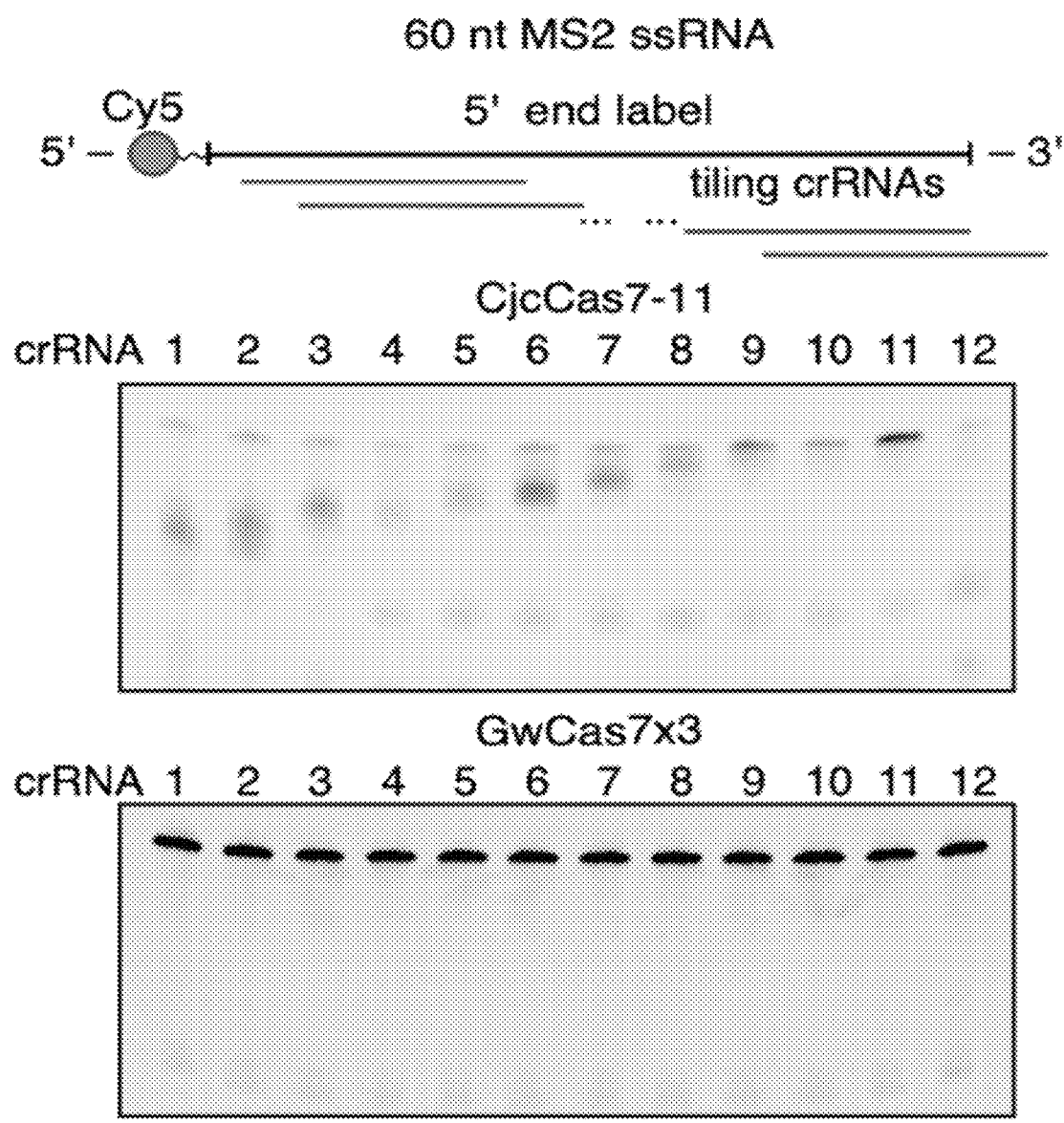
FIG. 7E illustrates the MS2 ssRNA target cleavage by GwCas7-11 and CjcCas7-11 incubated with their cognate crRNAs complementary to the MS2 ssRNA target according to embodiments of the present teachings.
Figure 7F:
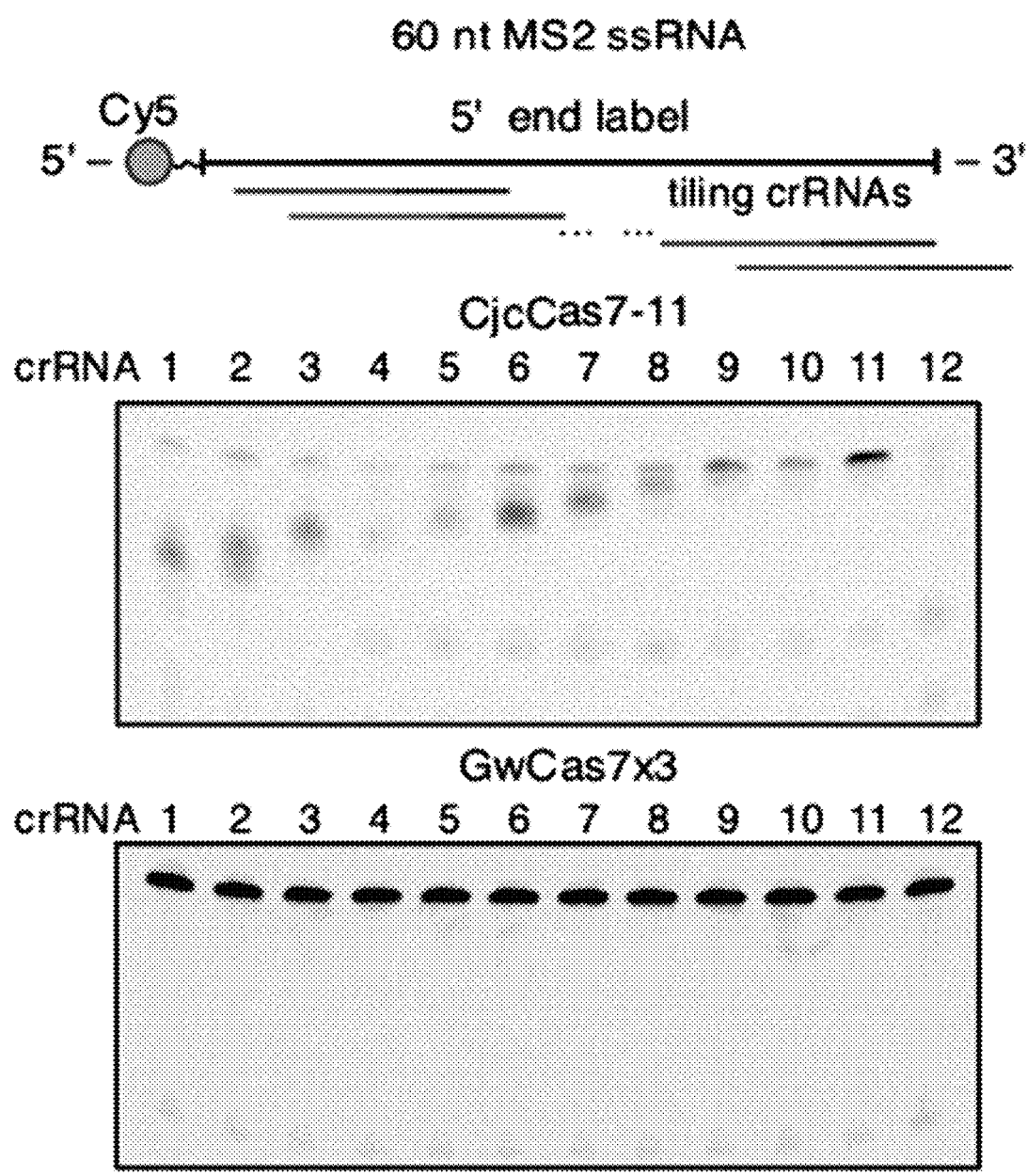
FIG. 7F illustrates the incubation of GwCas7×3 and CjcCas7-11 proteins with their cognate crRNAs complementary to the MS2 ssRNA target at varying positions along the target according to embodiments of the present teachings.

The activity of the GwCas7-11 orthologs at concentrations between 2 uM to 125 nM was assessed. The activity of Cas7-11 from Candidatus *Jettenia caeni* (CjcCas7-11) shows robust processing of CRISPR arrays specific to the CjcCas7-11 locus (FIG. 7C). The activity of Cas7-11 from ground water metagenomes (GwCas7-11) shows robust processing of CRISPR arrays specific to the GwCas7-11 locus (FIG. 7D). MS2 ssRNA target cleavage by GwCas7-11 and CjcCas7-11 incubated with their cognate crRNAs using guides complementary to the MS2 ssRNA target is illustrated in FIG. 7E. The incubation of GwCas7×3 and CjcCas7-11 proteins with their cognate crRNAs complementary to the MS2 ssRNA target at varying positions along the target is illustrated in FIG. 7F.

Example 7

Cas7-11 RNA Knockdown in Mammalian Cells

Figure 8A:
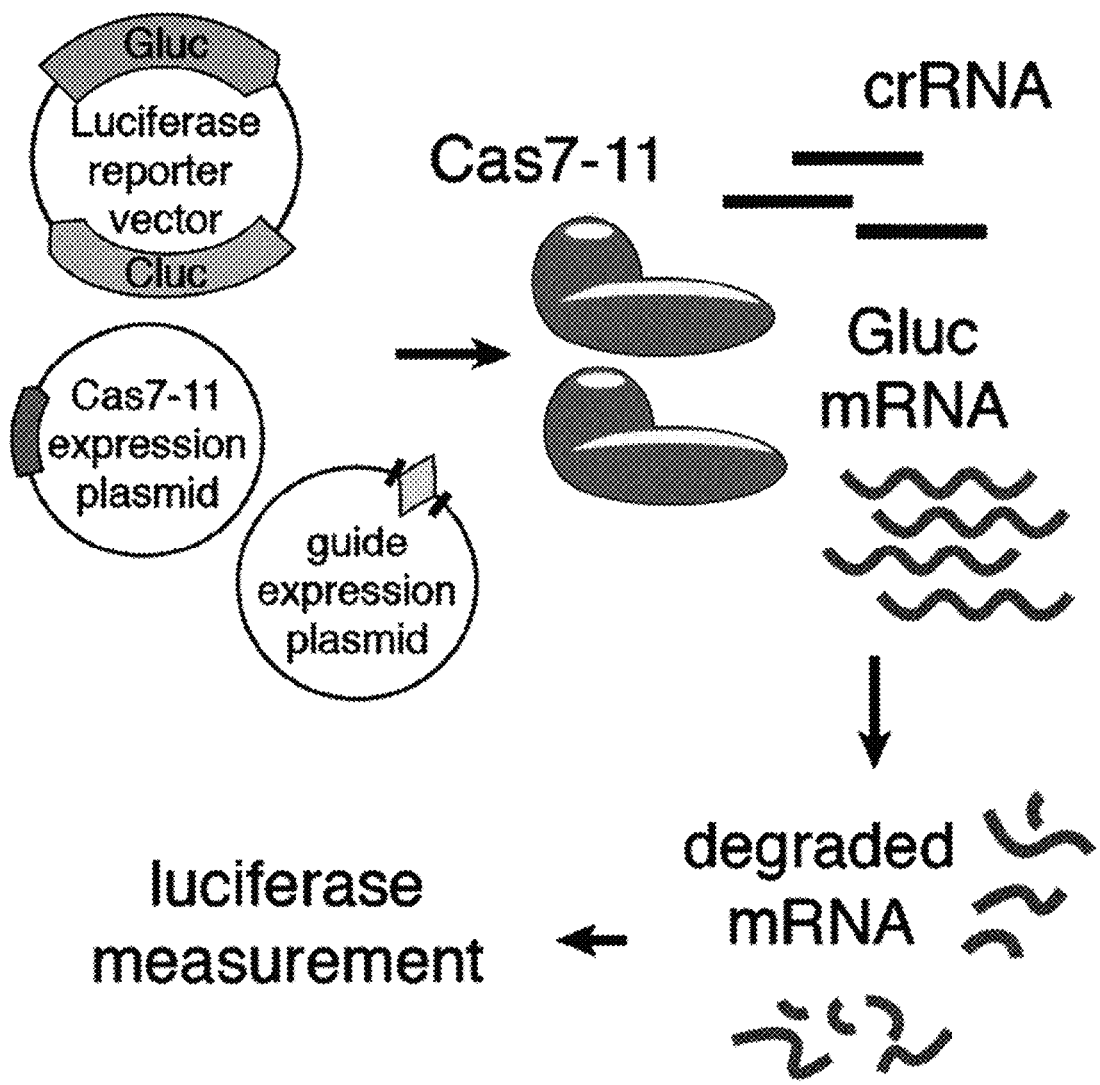
FIG. 8A is a schematic of a luciferase reporter assay for RNA knockdown using a vector expressing human codon-optimized DisCas7-11 and guide RNA according to embodiments of the present teachings.
Figure 8B:
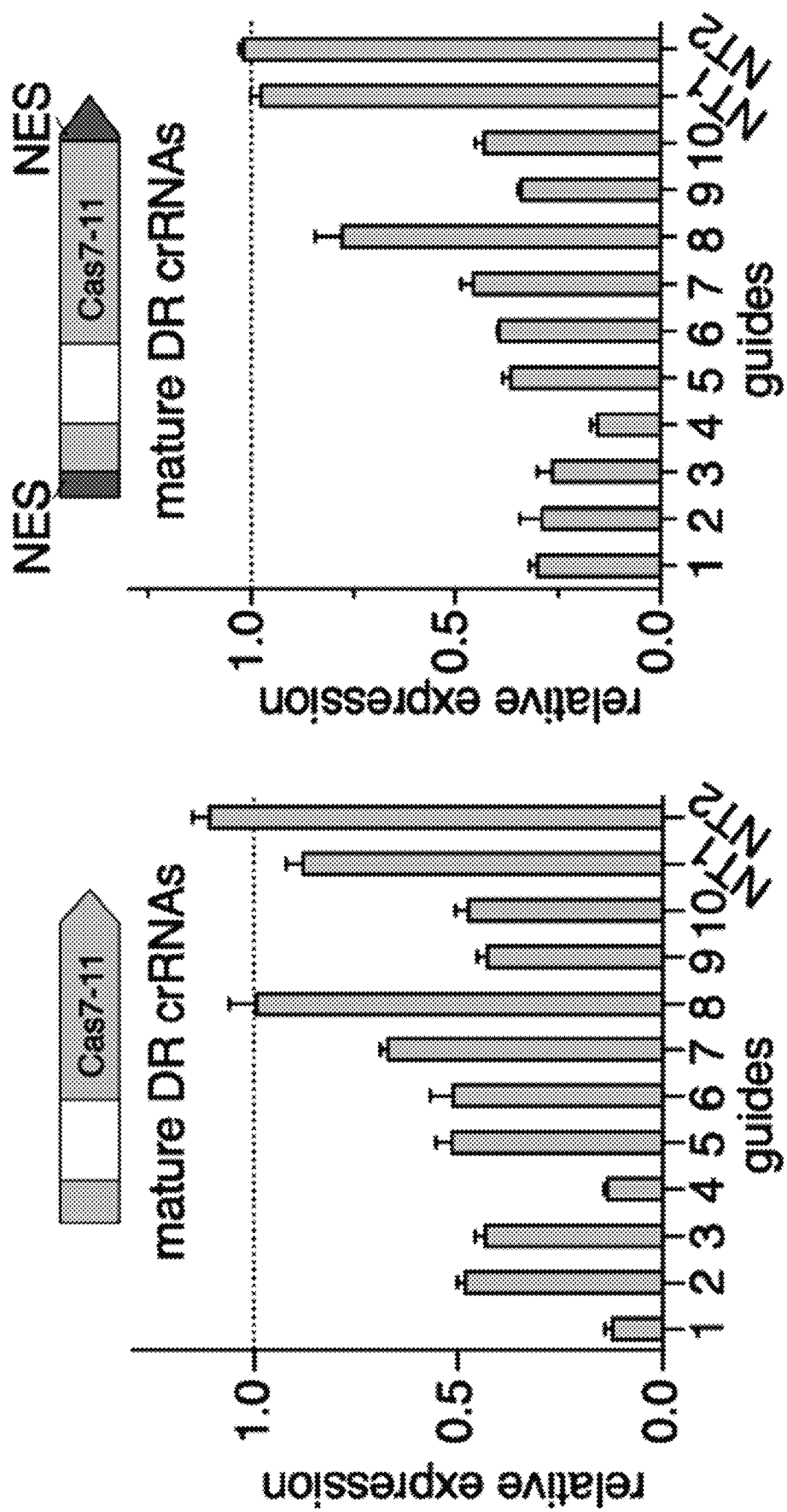
FIG. 8B is a diagram of the knockdown activity of DisCas7-11 against the *Gaussia* luciferase (Gluc) transcript normalized to two non-targeting conditions according to embodiments of the present teachings.
Figure 8C:
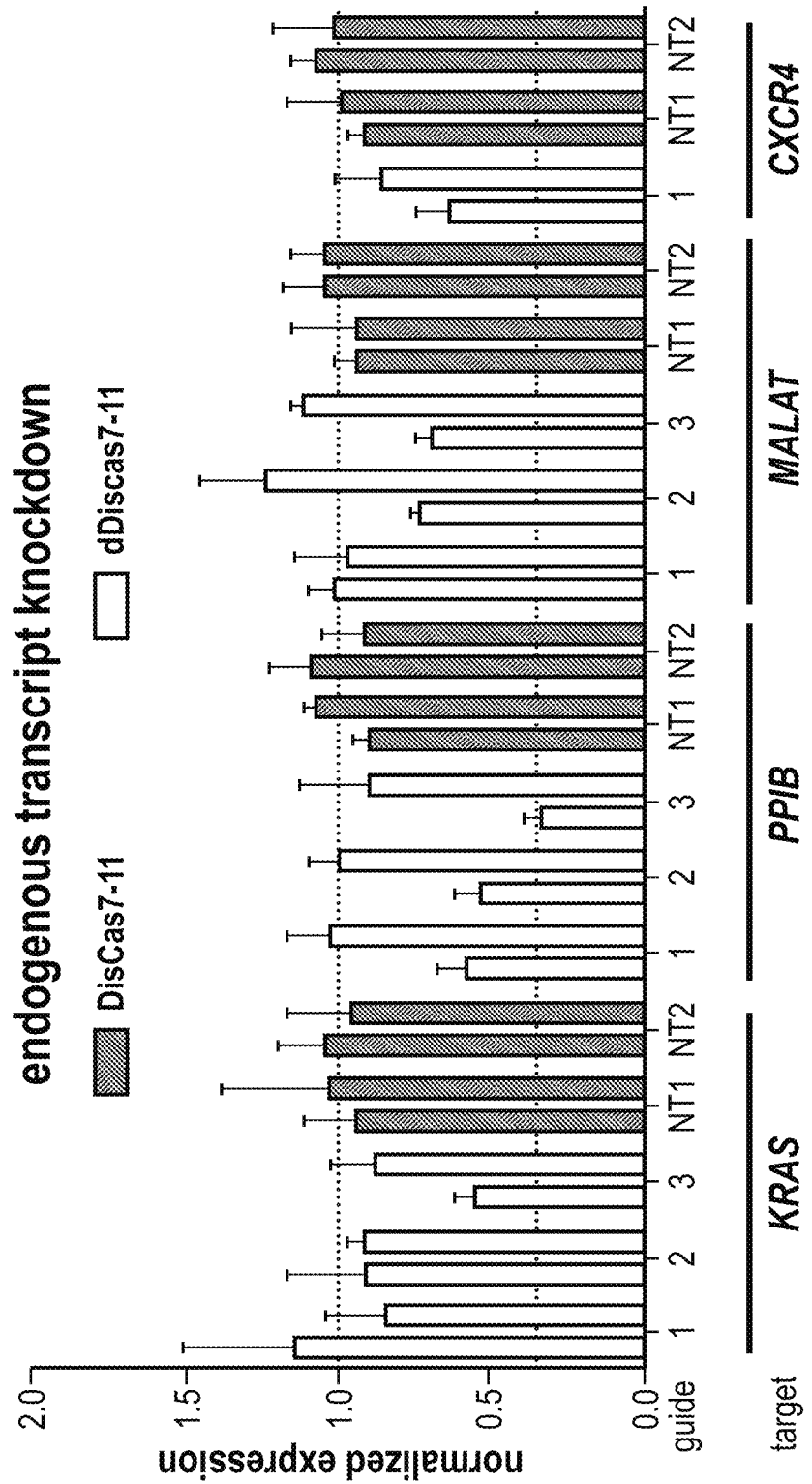
FIG. 8C is a diagram showing the knockdown activity of DisCas7-11 against the multiple endogenous transcripts normalized to two non-targeting according to embodiments of the present teachings.
Figure 8D:
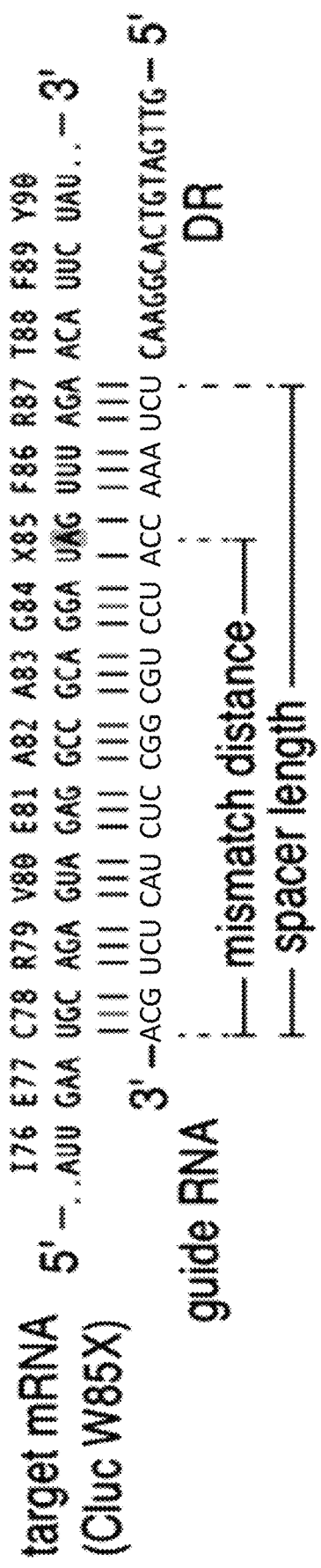
FIG. 8D is a schematic of the DisCas7-11a guide design for programmable A-to-I editing according to embodiments of the present teachings. Figure discloses SEQ ID NOS 639-640, respectively, in order of appearance.

The knockdown of RNA in mammalian cells by DisCas7-11 was evaluated. The schematic of a luciferase reporter assay for RNA knockdown using a vector expressing human codon-optimized DisCas7-11 and guide RNA is shown in FIG. 8A. The knockdown activity of DisCas7-11 against the *Gaussia* luciferase (Gluc) transcript normalized to two non-targeting conditions is illustrated in FIG. 8B. Note that the dotted line in this FIG. represents 85% knockdown. The knockdown activity of DisCas7-11 against the multiple endogenous transcripts normalized to two non-targeting conditions is illustrated in FIG. 8C. Note that the dotted lines in this figure represent background expression and 65% knockdown by DisCas7-11.

Figure 8E:
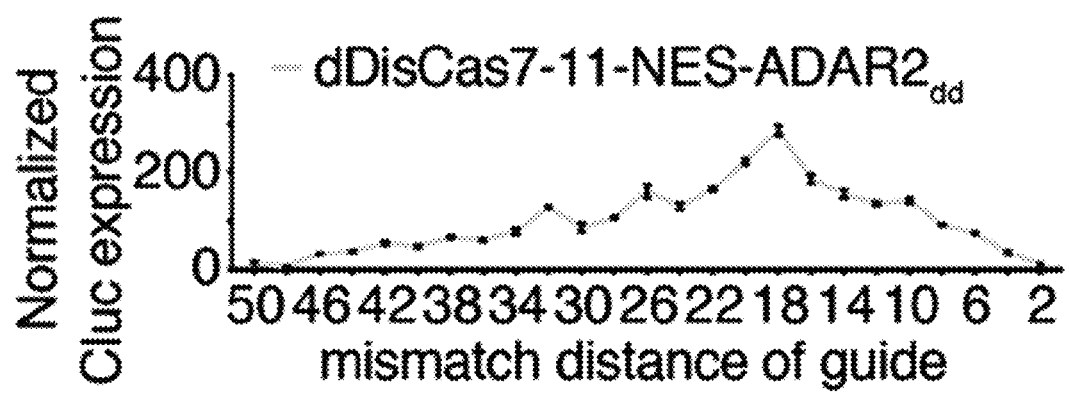
FIG. 8E is a diagram showing the RNA A-to-I editing of *Cypridina* luciferase (Cluc) mRNA W85X mutation in mammalian cells by dead DisCas7-11a-NES-ADAR2 according to embodiments of the present teachings.
Figure 8F:
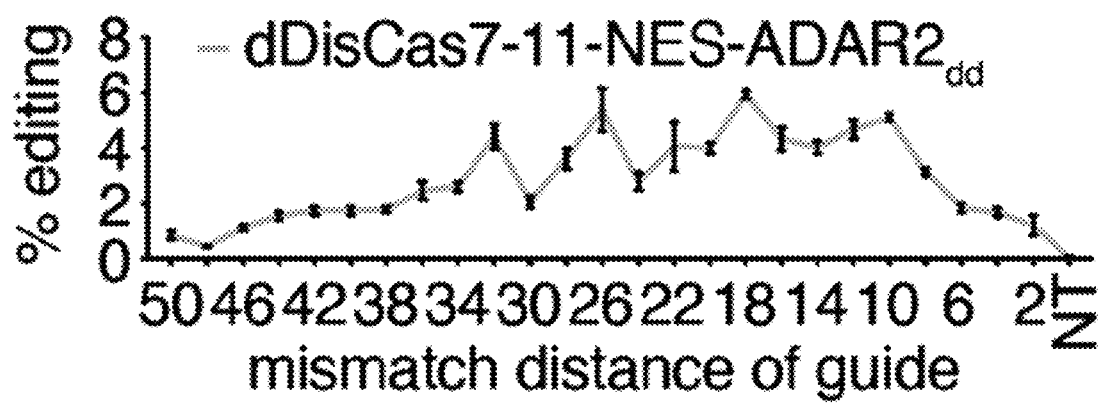
FIG. 8F is a diagram showing the RNA A-to-I editing of *Cypridina* luciferase (Cluc) mRNA W85X mutation in mammalian cells by dead DisCas7-11a-NES-ADAR2 according to embodiments of the present teachings.

RNA A-to-I editing of *Cypridina* luciferase (Cluc) mRNA W85X mutation in mammalian cells by dead DisCas7-11a-NES-ADAR2 was investigated. Guides were designed with mismatch distances between 2-50 nt. Editing was measured by two methods: 1) restoration of Cluc luciferase activity that is normalized to the non-targeting guide condition (FIG. 8E) and 2) amplicon sequencing of the targeted adenosine to measure percent conversion of the adenosine to inosine (FIG. 8F).

Figure 8G:
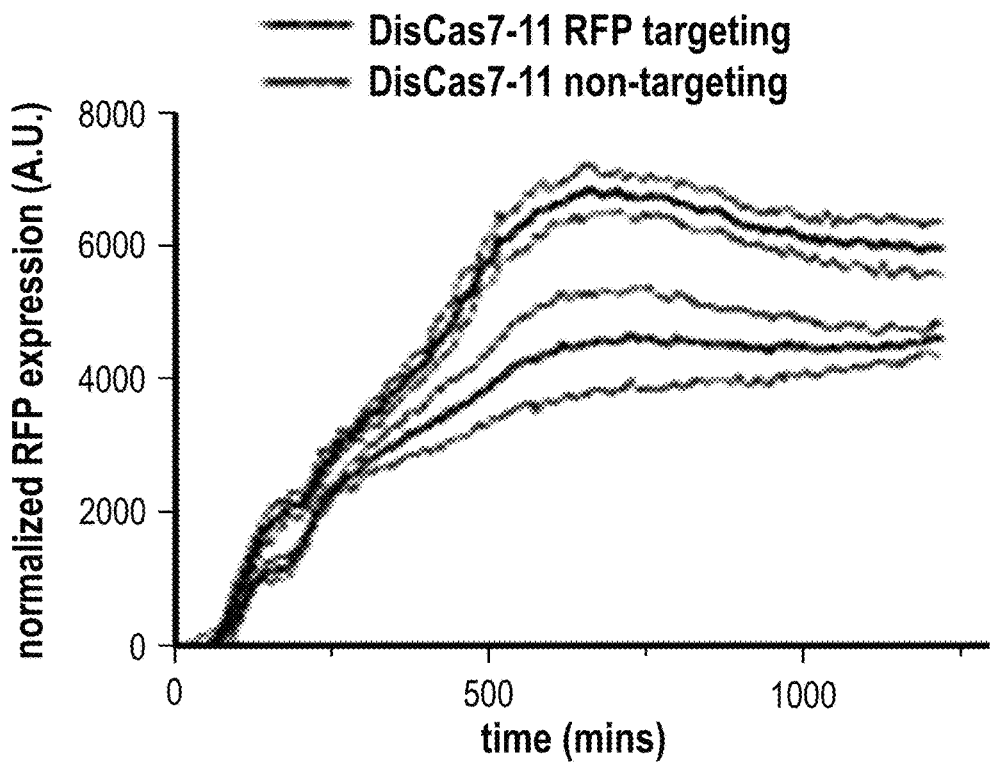
FIG. 8G is a graph illustrating the RFP knockdown by DisCas7-11 or LwaCas13a in *E. coli* bacteria according to embodiments of the present teachings.
Figure 8H:
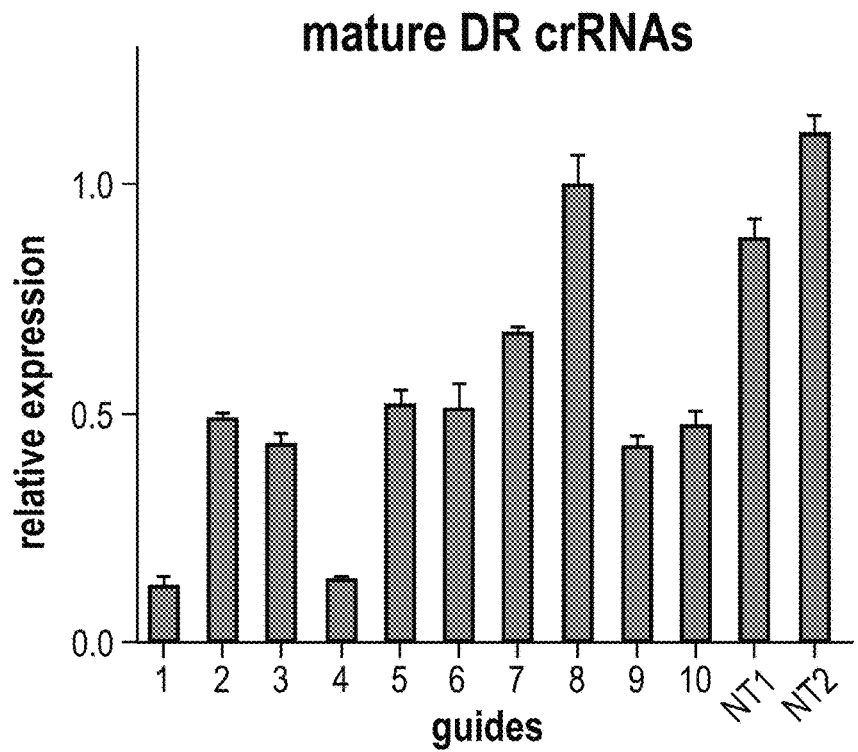
FIG. 8H is a bar graph illustrating the knockdown of Gluc mRNA in mammalian cell by DisCas7-11 with a panel of guides containing the mature DR sequence according to embodiments of the present teachings.
Figure 8I:
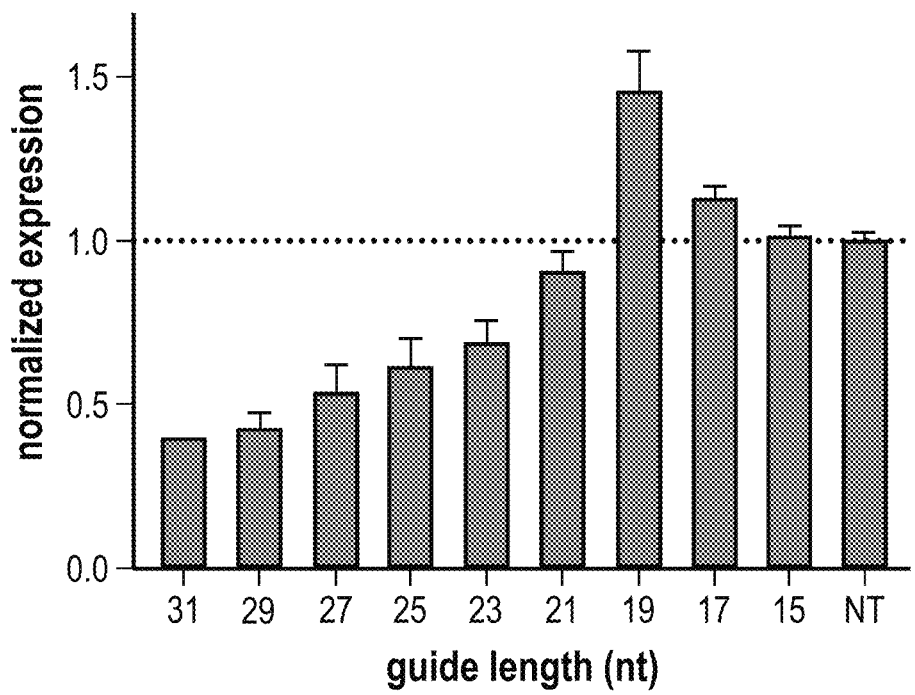
FIG. 8I is a bar graph illustrating knockdown of Gluc mRNA in mammalian cells by DisCas7-11 with a panel of guides of different lengths according to embodiments of the present teachings.
Figure 8J:
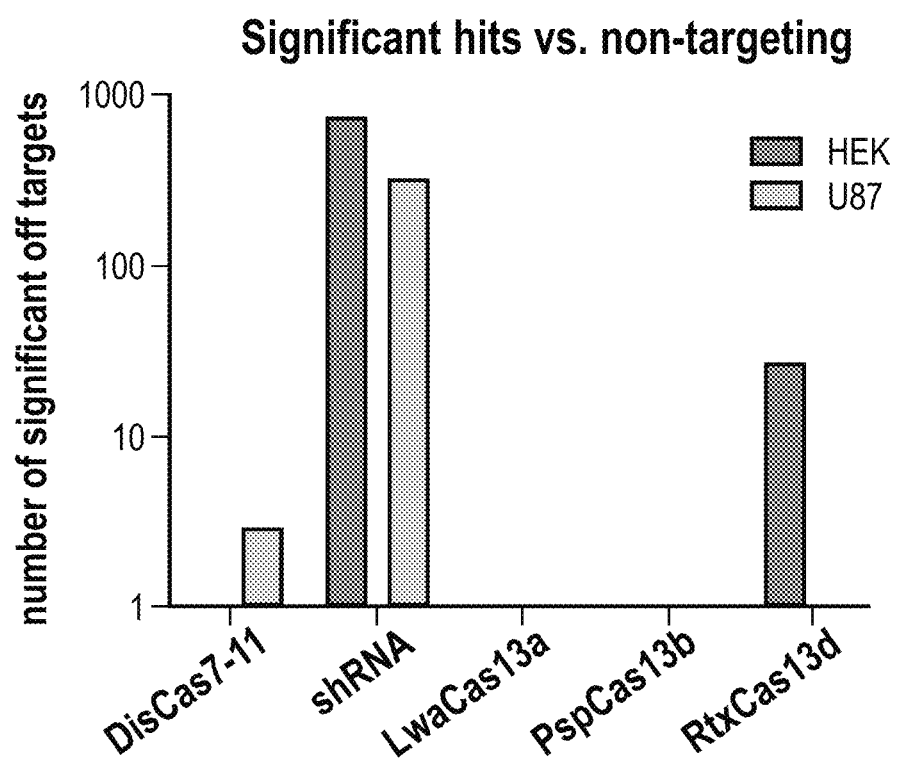
FIG. 8J is a bar graph comparing the number of significant off-targets when targeting the Gluc transcript in HEK293FT and U87 cells by DisCas7-11, shRNA, LwaCas13a, PspCas13b, and RfxCas13d using transcriptome-wide RNA-sequencing data according to embodiments of the present teachings.
Figure 8K:
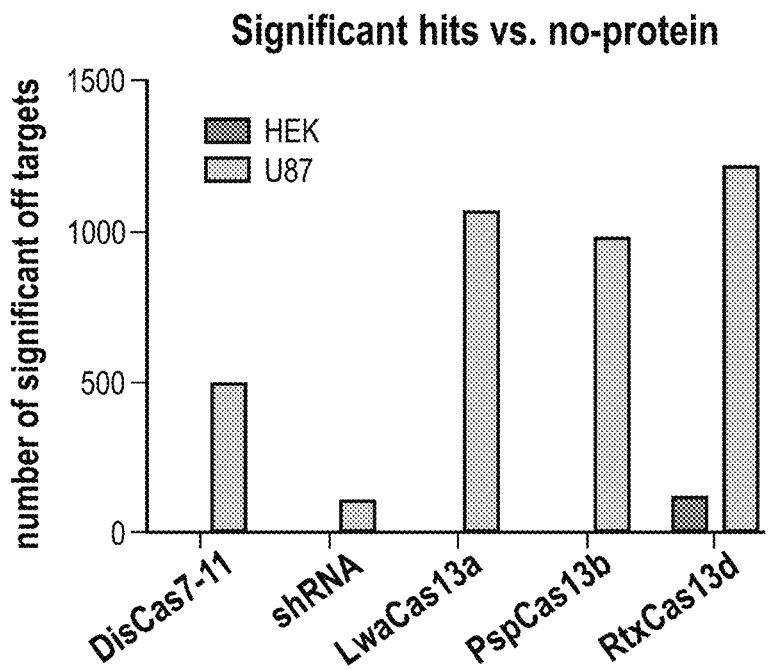
FIG. 8K is a bar graph comparing the number of significant off-targets when targeting the Gluc transcript in HEK293FT and U87 cells by DisCas7-11, shRNA, LwaCas13a, PspCas13b, and RfxCas13d using transcriptome-wide RNA sequencing data according to embodiments of the present teachings.

The RFP knockdown by DisCas7-11 or LwaCas13a in *E. coli* bacteria was assessed (FIG. 8G). The knockdown of Gluc mRNA in mammalian cells by DisCas7-11 with a panel of guides containing the mature DR sequence was assessed (FIG. 8H). The guides were designed to be tiled across the Gluc transcript. The knockdown of Gluc mRNA in mammalian cells by DisCas7-11 with a panel of guides of different lengths was assessed (FIG. 8I). Comparison of the number of significant off-targets when targeting the Gluc transcript in HEK293FT and U87 cells by DisCas7-11, shRNA, LwaCas13a, PspCas13b, and RfxCas13d using transcriptome-wide RNA-sequencing data is shown in FIG. 8G. Off-targets were determined by significance testing of differentially expressed transcripts between targeting and non-targeting guide conditions. Comparison of the number of significant off-targets when targeting the Gluc transcript in HEK293FT and U87 cells by DisCas7-11, shRNA, LwaCas13a, PspCas13b, and RfxCas13d using transcriptome-wide RNA1217 sequencing data is shown in FIG. 8K. Off-targets were determined by significance testing of differentially expressed transcripts between the targeting guide condition and cells only expressing EGFP. The data were mean (n=3)±s.e.m.

Figure 8L:
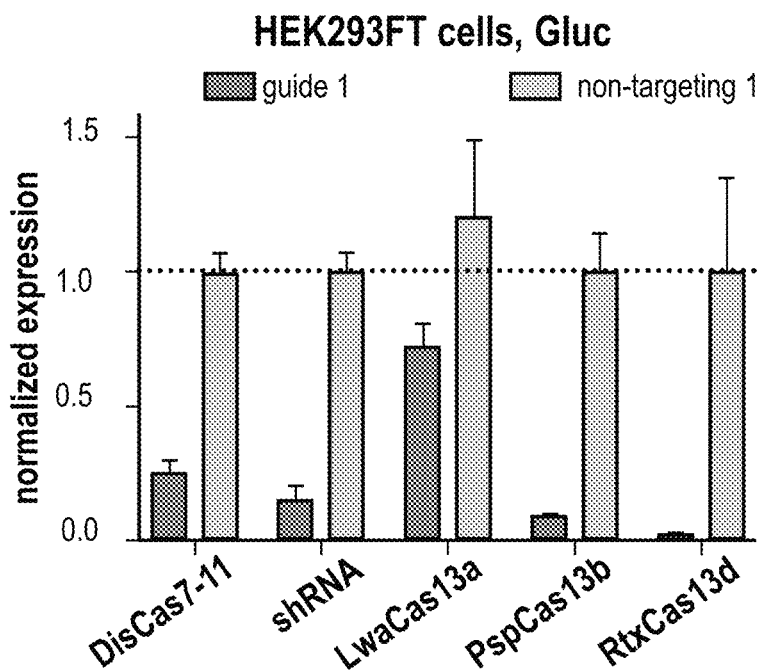
FIG. 8L is a bar graph showing the knockdown activity in HEK293FT cells of DisCas7-11, shRNA, LwaCas13a, PspCas13b, and RfxCas13d against the *Gaussia* luciferase (Gluc) transcript normalized to corresponding non-targeting controls according to the embodiments of the present teachings.
Figure 8M:
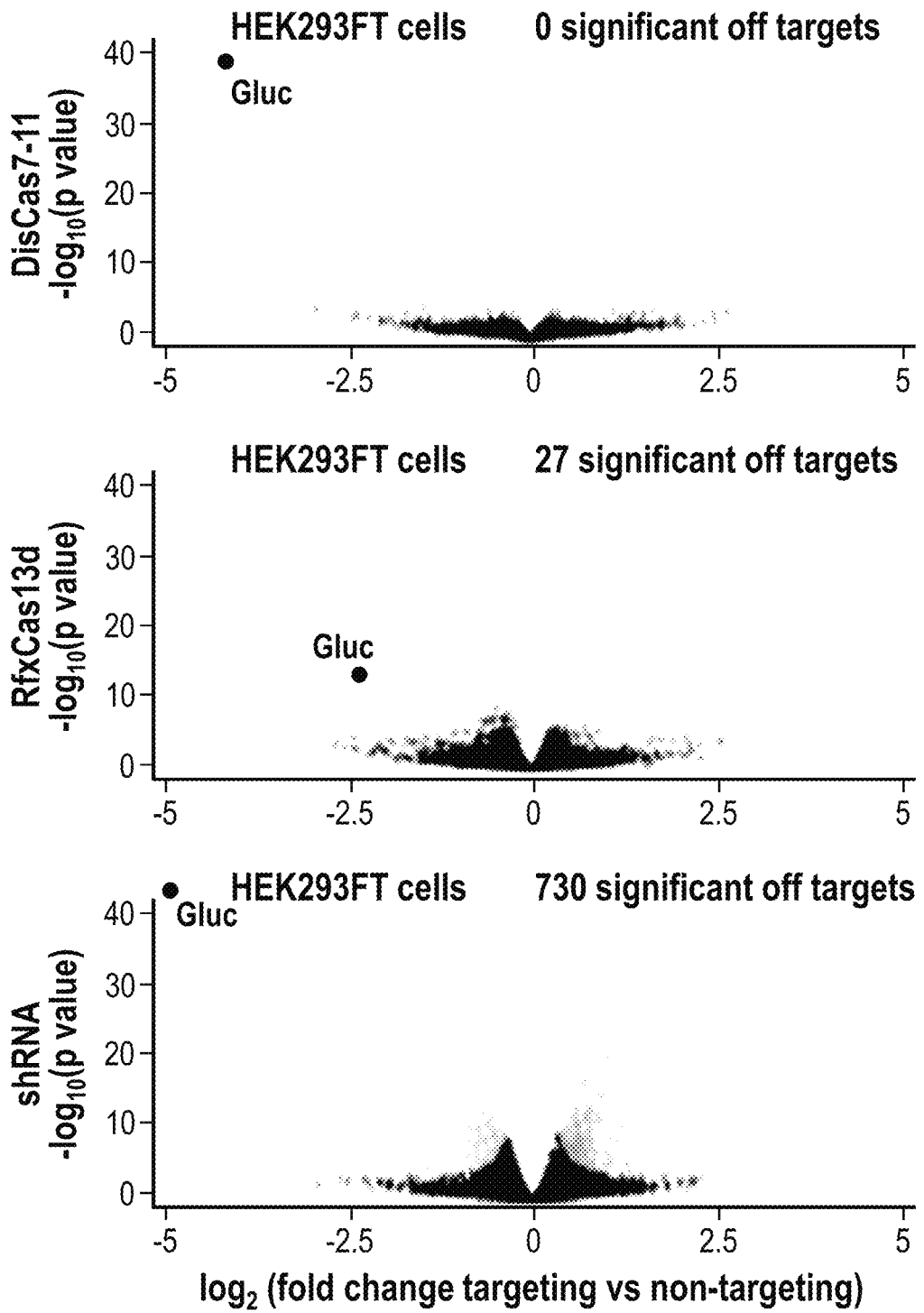
FIG. 8M shows the transcriptome wide specificity in HEK293FT cells of RNA knockdown by DisCas7-11, RfxCas13d, and shRNA against the *Gaussia* luciferase (Gluc) transcript, wherein the analysis off targets is performed via significance testing (y-axis) of differentially expressed transcripts (x-axis) between targeting and non-targeting guide conditions (n=3) and the number of significant off-targets is displayed according to embodiments of the present teachings.
Figure 8N:
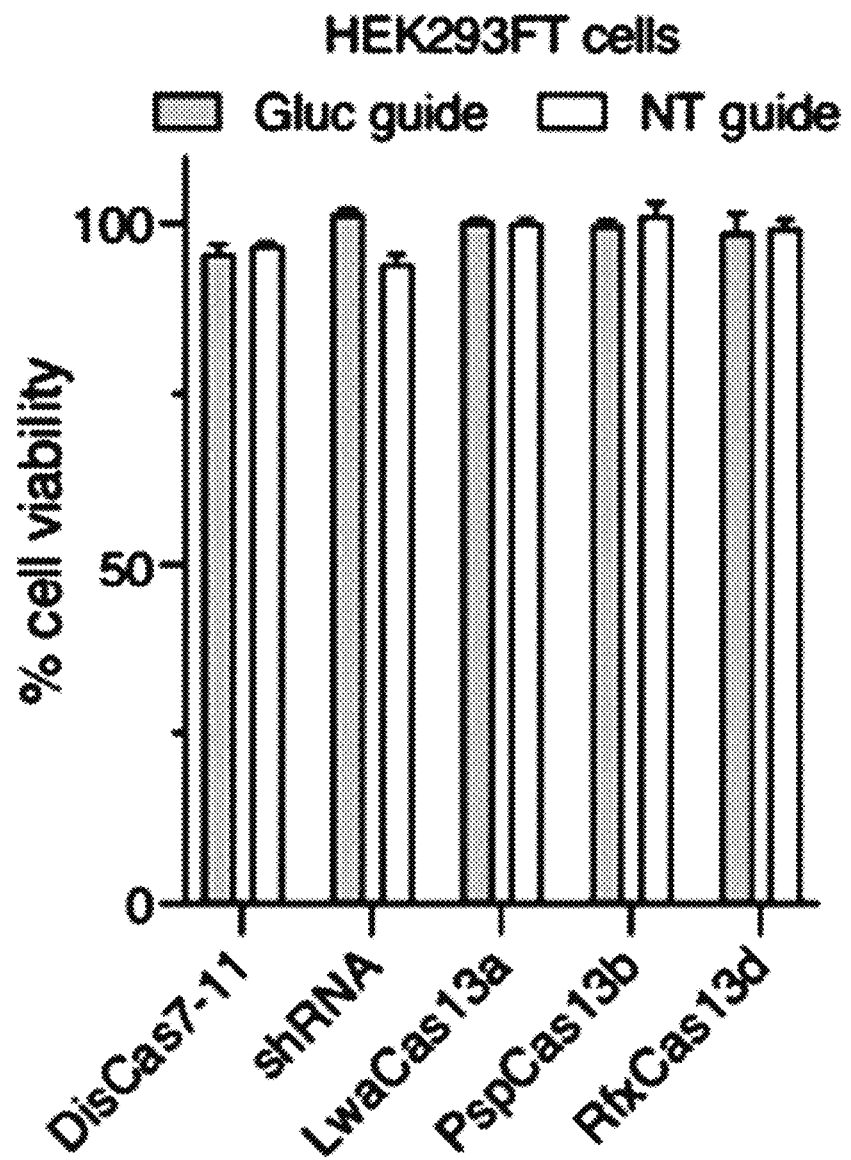
FIG. 8N is a bar graph showing the cell viability of HEK293FT cells during RNA knockdown by DisCas7-11, shRNA, LwaCas13a, PspCas13b, and RfxCas13d against the *Gaussia* luciferase (Gluc) transcript according to embodiments of the present teachings.
Figure 8O:
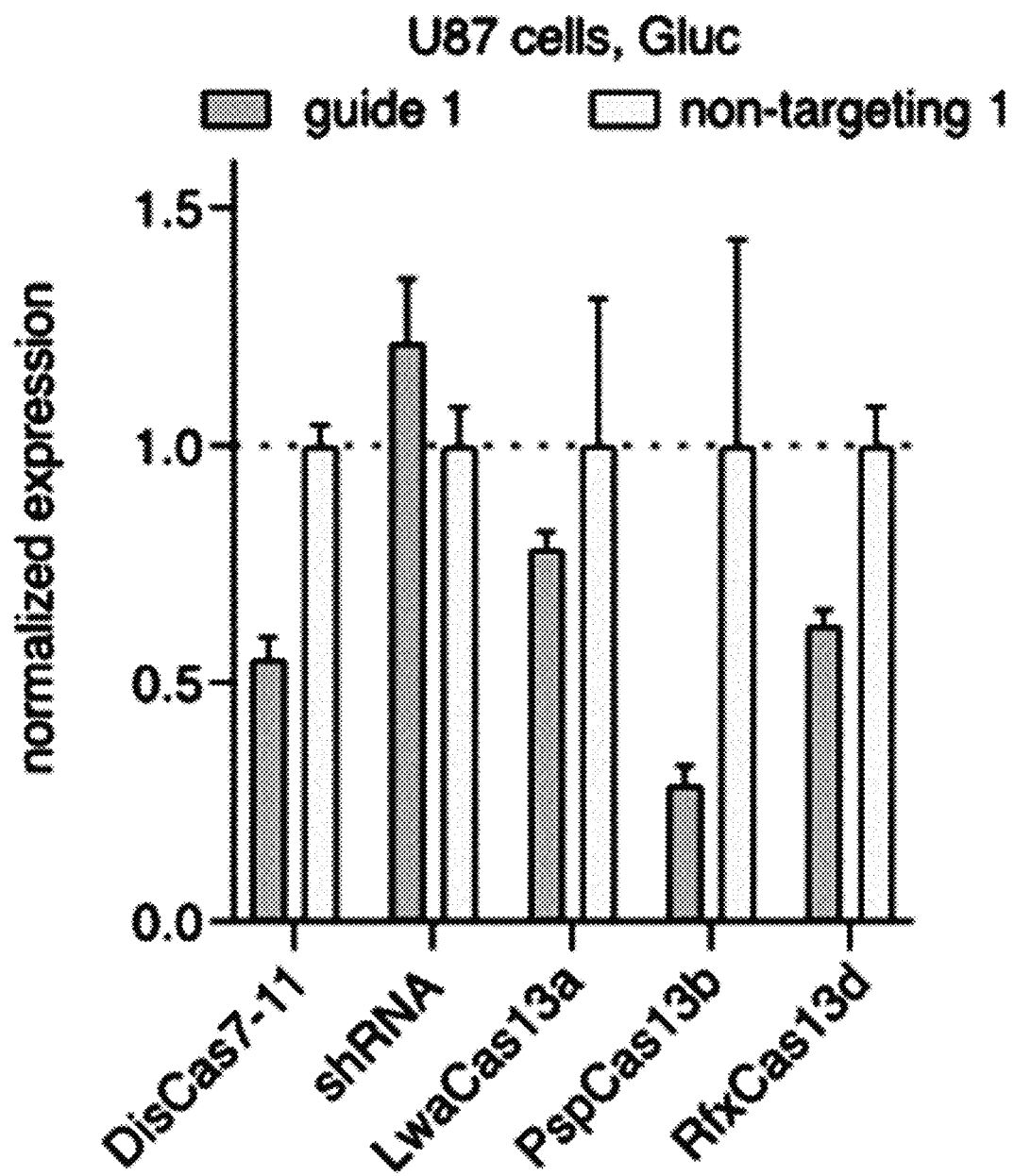
FIG. 8O is a bar graph of the knockdown activity in U87 glioblastoma cells of DisCas7-11, shRNA, LwaCas13a, PspCas13b, and RfxCas13d against the *Gaussia* luciferase (Gluc) transcript normalized to corresponding non-targeting controls according to embodiments of the present teachings.
Figure 8P:
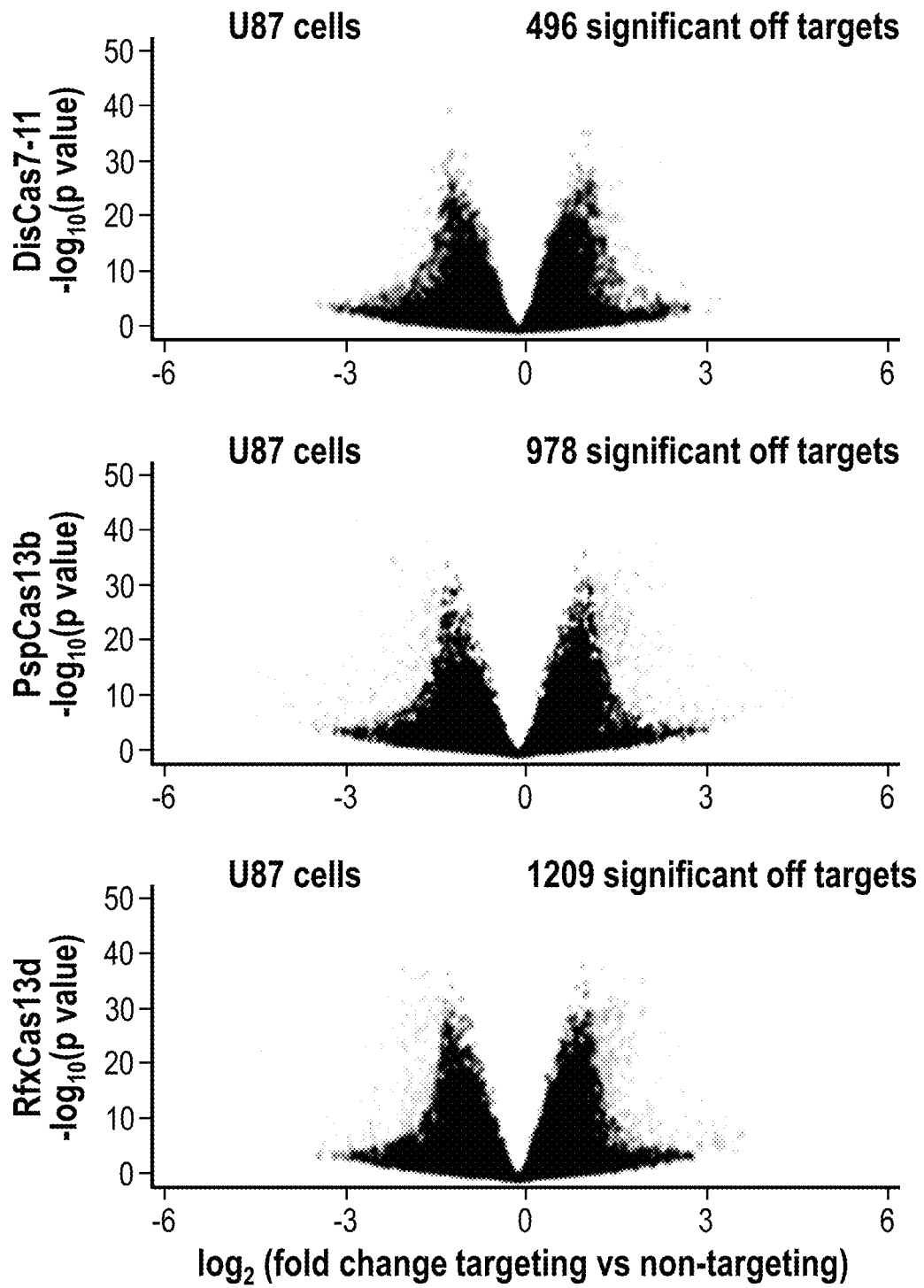
FIG. 8P is showing the transcriptome wide specificity in U87 glioblastoma cells of RNA knockdown by DisCas7-11, PspCas13b, and RfxCas13d against the *Gaussia* luciferase (Gluc) transcript, wherein the analysis off targets is performed via significance testing (y-axis) of differentially expressed transcripts (x-axis) between the targeting guide condition and cells only expressing EGFP (n=3) and the number of significant off-targets is displayed according to embodiments of the present teachings.
Figure 8Q:
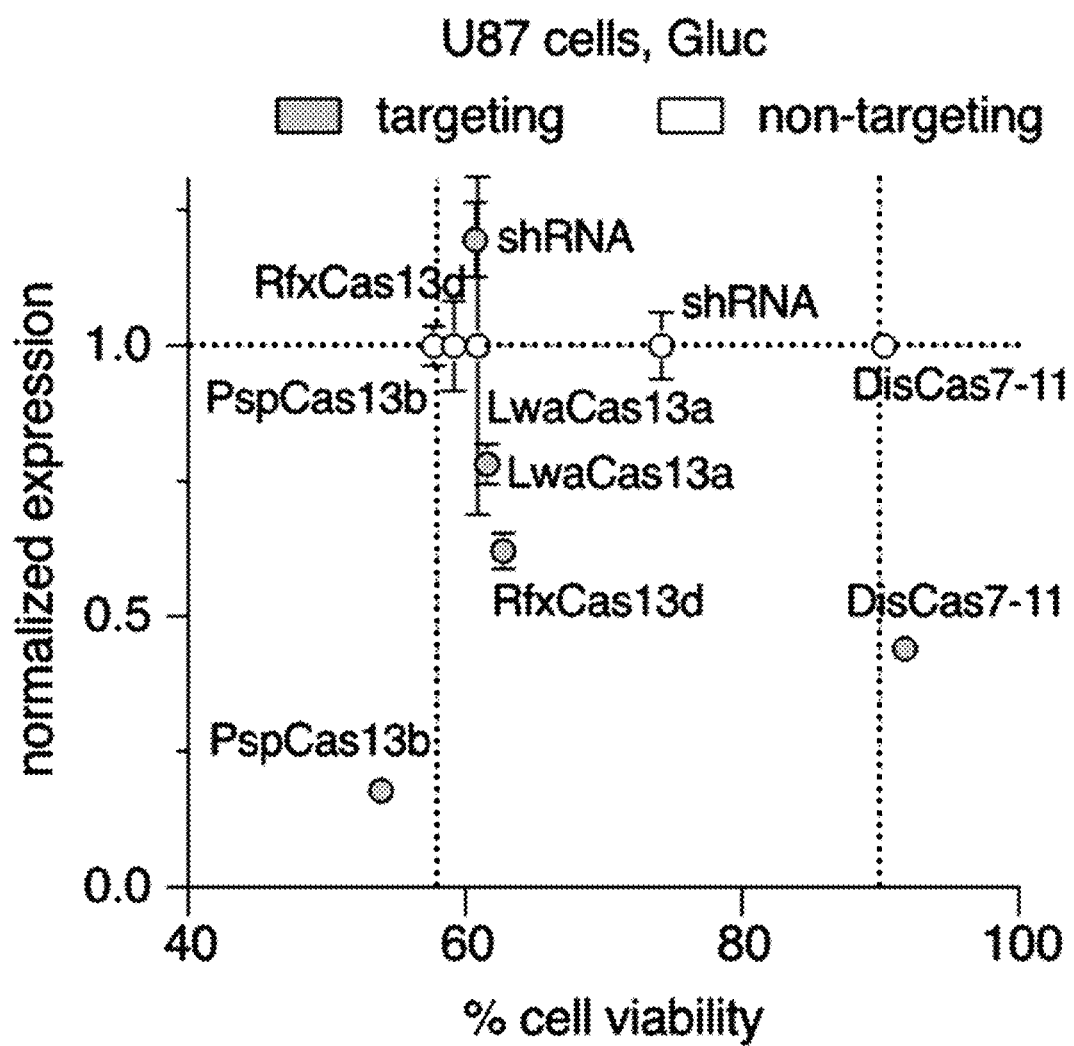
FIG. 8Q is a graph of the cell viability of U87 glioblastoma cells during RNA knockdown by DisCas7-11, shRNA, LwaCas13a, PspCas13b, and RfxCas13d against the *Gaussia* luciferase (Gluc) transcript, wherein the data are mean (n=3)±s.e.m. according to embodiments of the present teachings.
Figure 8R:
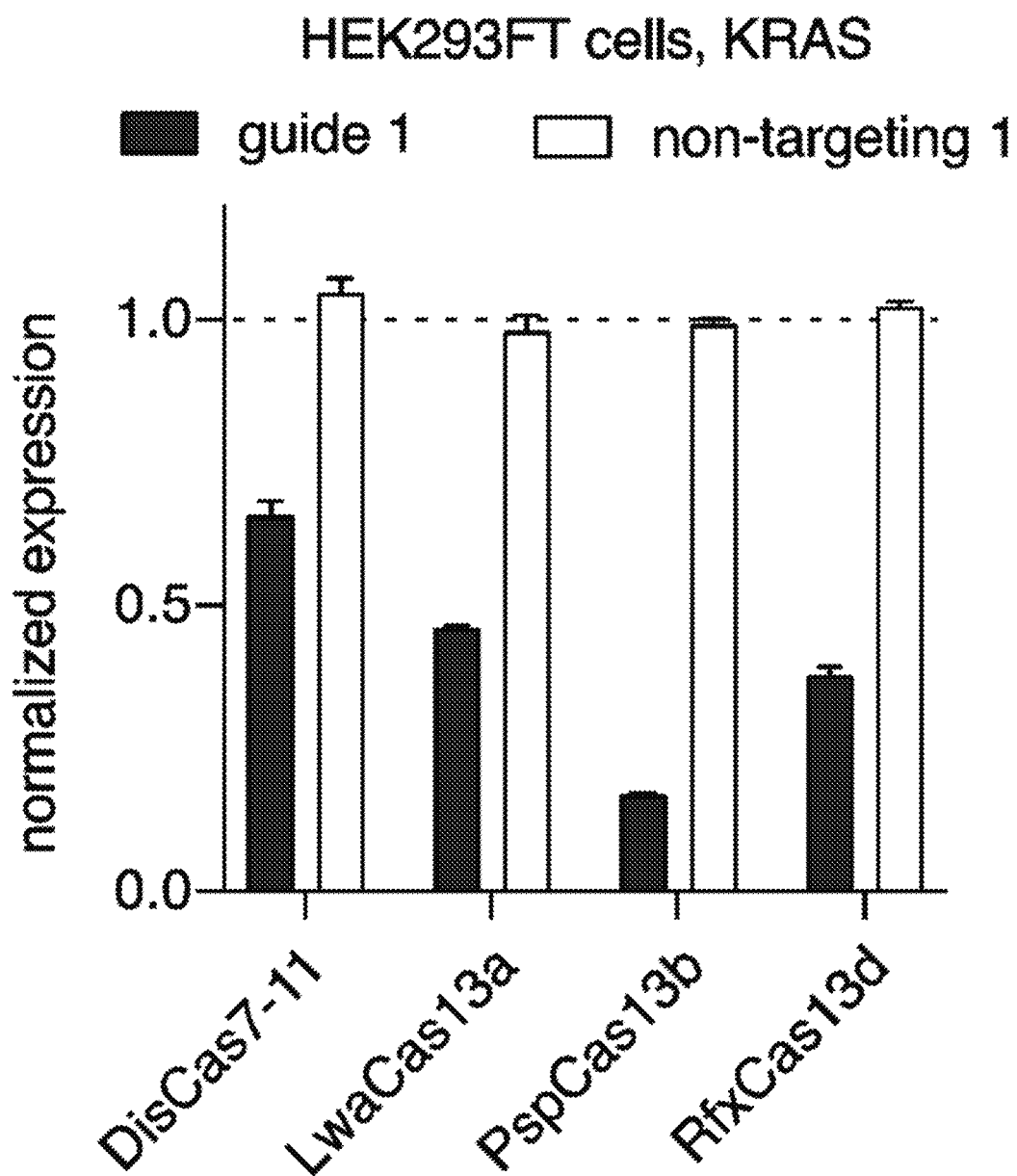
FIG. 8R is a graph showing the knockdown activity in HEK293FT cells of DisCas7-11, LwaCas13a, PspCas13b, and RfxCas13d against the KRAS transcript normalized to corresponding non-targeting controls according to embodiments of the present teachings.
Figure 8S:
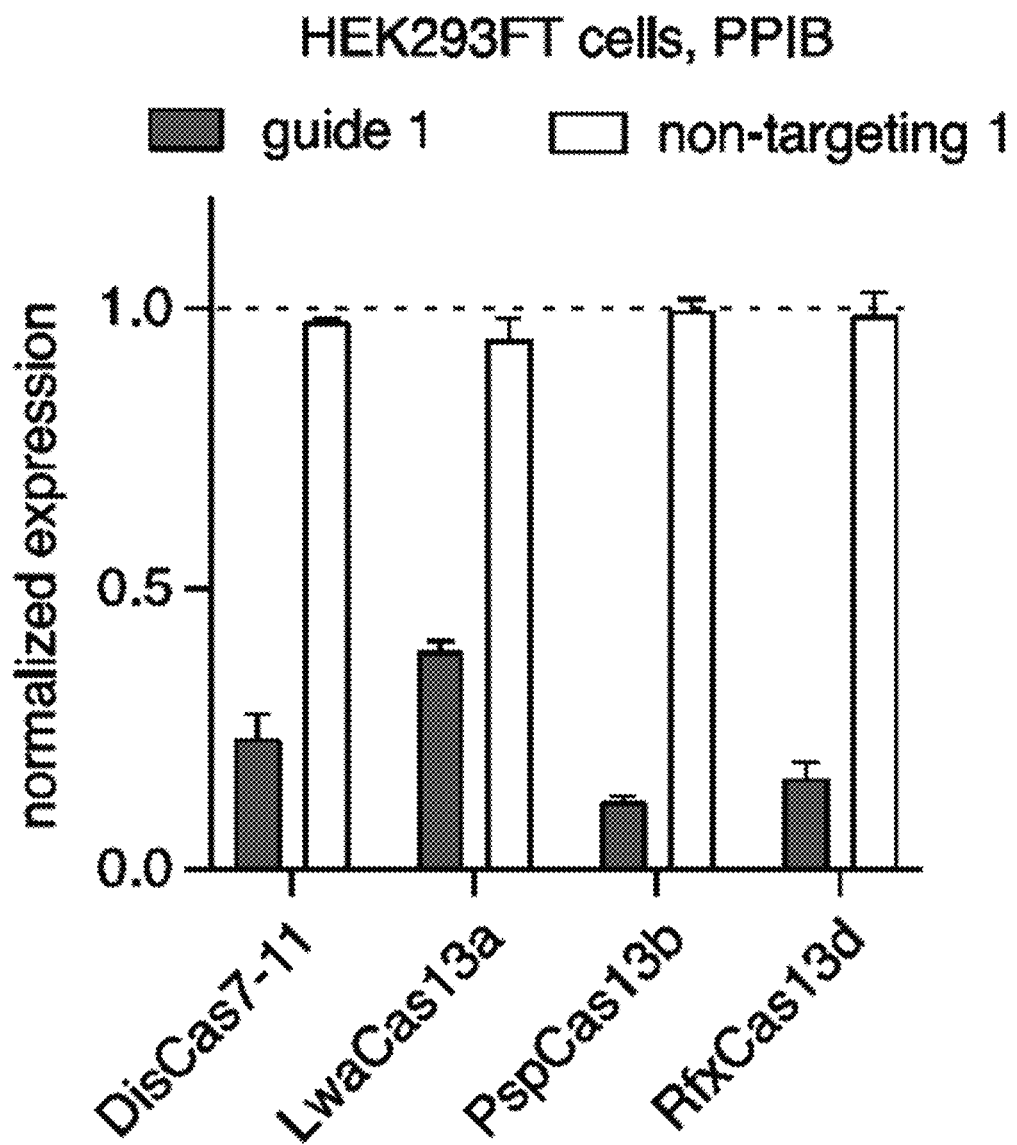
FIG. 8S is a graph showing the knockdown activity in HEK293FT cells of DisCas7-11, LwaCas13a, PspCas13b, and RfxCas13d against the PPIB transcript normalized to corresponding non-targeting controls according to embodiments of the present teachings.
Figure 8T:
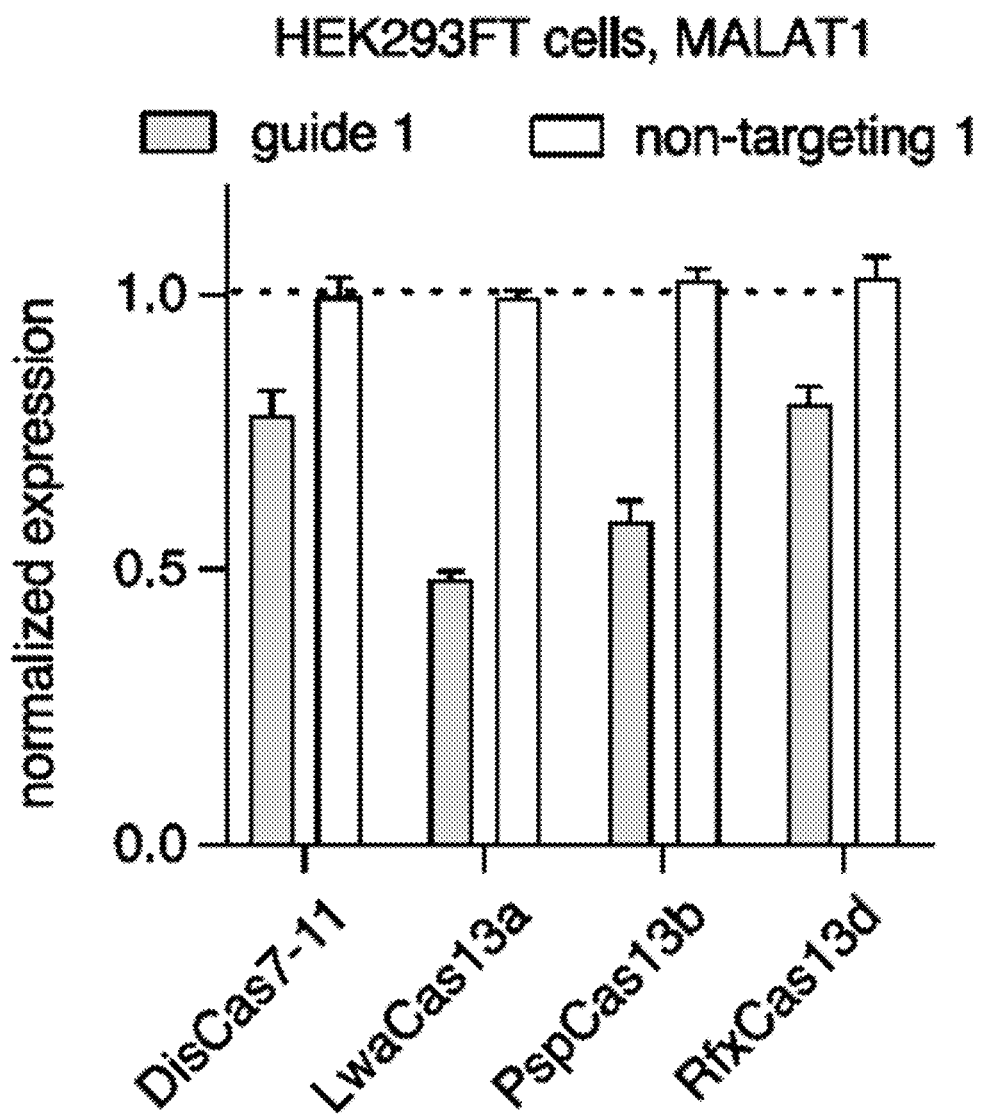
FIG. 8T is a graph showing the knockdown activity in HEK293FT cells of DisCas7-11, LwaCas13a, PspCas13b, and RfxCas13d against the MALAT transcript normalized to corresponding non-targeting controls according to embodiments of the present teachings.
Figure 8U:
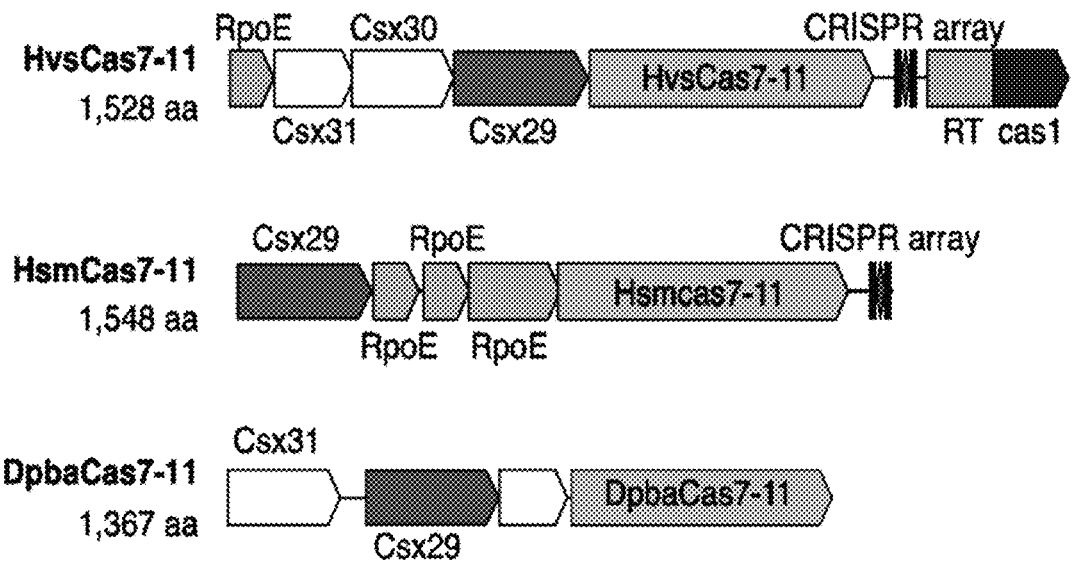
FIG. 8U is a schematic of type III-E loci from Hydrothermal vent microbial metagenome sample, Hydrothermal sediment microbial communities metagenome sample, and Deltaproteobacteria bacterium, containing HvsCas7-11, HsmCas7-11, and DpbaCas7-11 respectively according to embodiments of the present teachings.
Figure 8V:
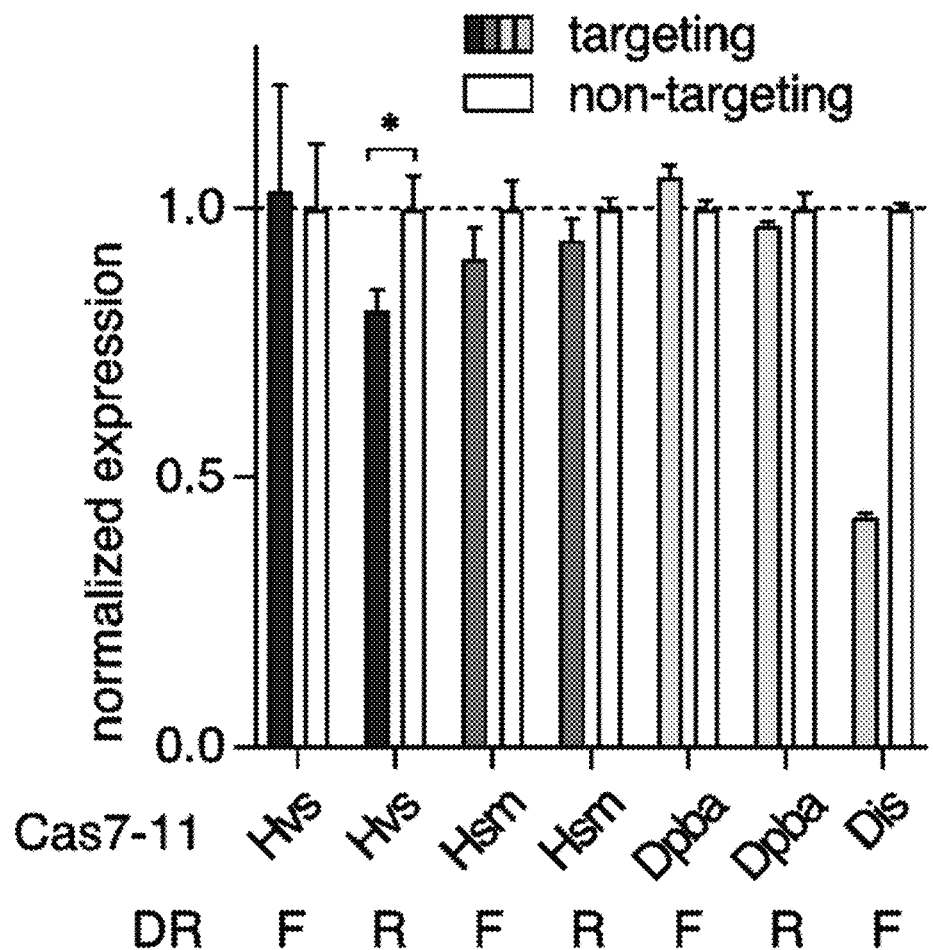
FIG. 8V is a graph showing the knockdown activity in HEK293FT cells of HvsCas7-11, HsmCas7-11, DpbaCas7-11, and DisCas7-11 against the *Gaussia* luciferase (Gluc) transcript normalized to corresponding non-targeting controls, wherein for HvsCas7-11, HsmCas7-11, and DpbaCas7-11, two DR orientations ("F" and "R") were tested, and wherein significance tests are measured by a Student's t-test (*, p-value <0.05; **, p-value <0.01) according to embodiments of the present teachings.
Figure 8W:
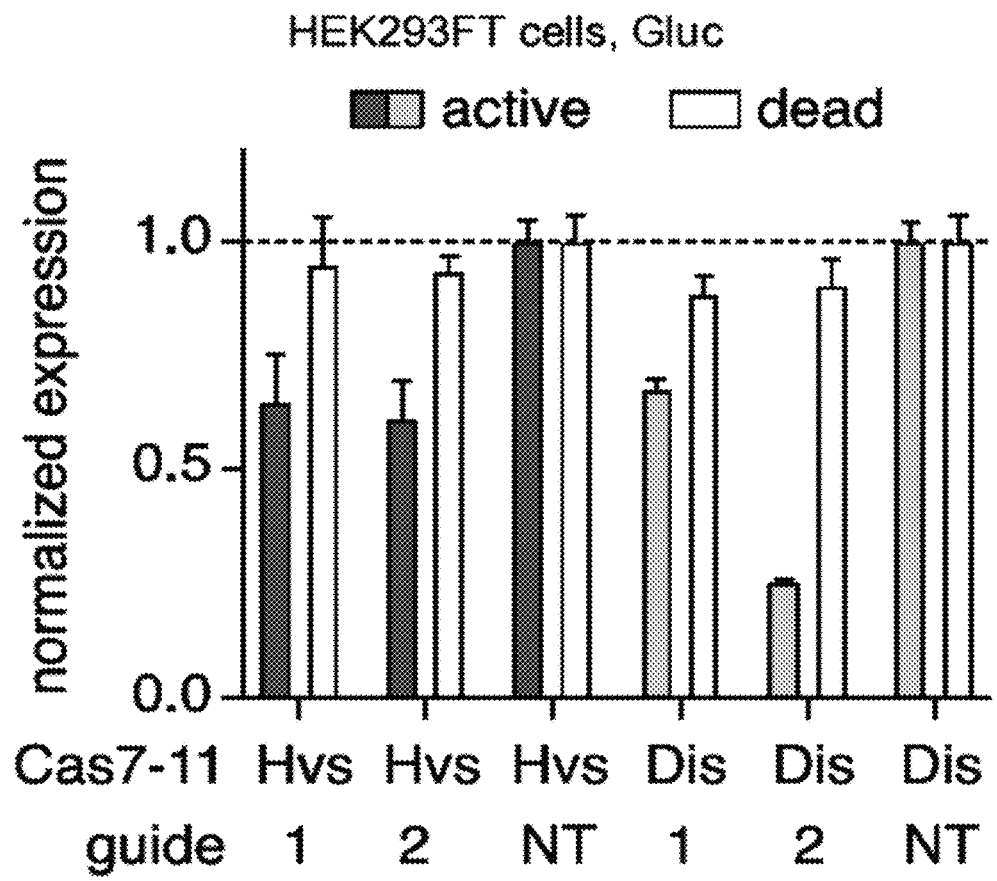
FIG. 8W is a graph showing the knockdown activity in HEK293FT cells of HvsCas7-11 and DisCas7-11 with two distinct target guides, with and without catalytic mutations in the Cas7-11 proteins according to embodiments of the present teachings.
Figure 8X:
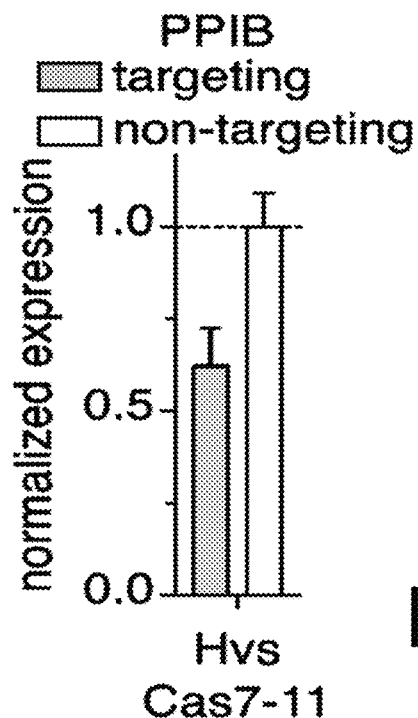
FIG. 8X is a graph showing the knockdown activity in HEK293FT cells of HvsCas7-11 against the PPIB transcript normalized to corresponding non-targeting controls according to embodiments of the present teachings.
Figure 8Y:
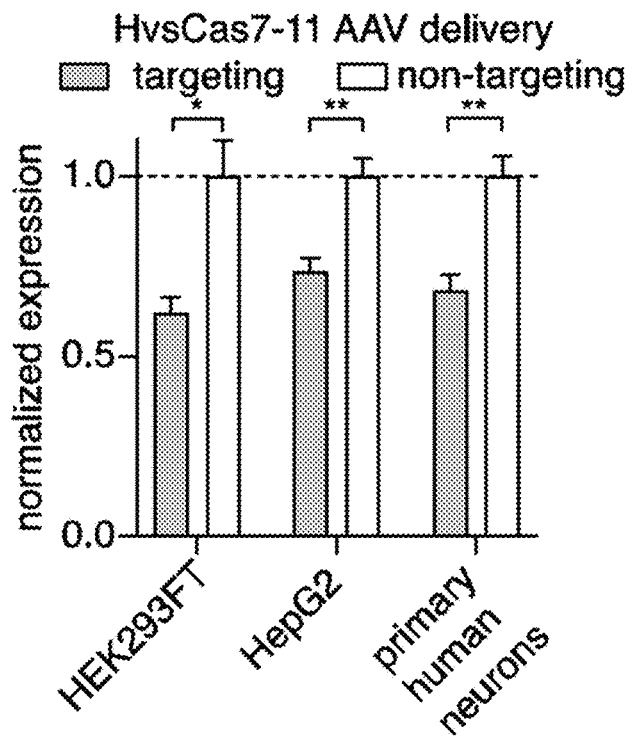
FIG. 8Y is a graph showing the knockdown activity in HEK293FT, HepG2, and primary neuron cultures of HvsCas7-11 delivered as a two vector AAV system targeting the *Gaussia* luciferase (Gluc) transcript, wherein values are normalized to corresponding non-targeting controls, and wherein significance tests are measured by a Student's t-test (*, p-value <0.05; **, p-value <0.01) according to embodiments of the present teachings.
Figure 8Z:
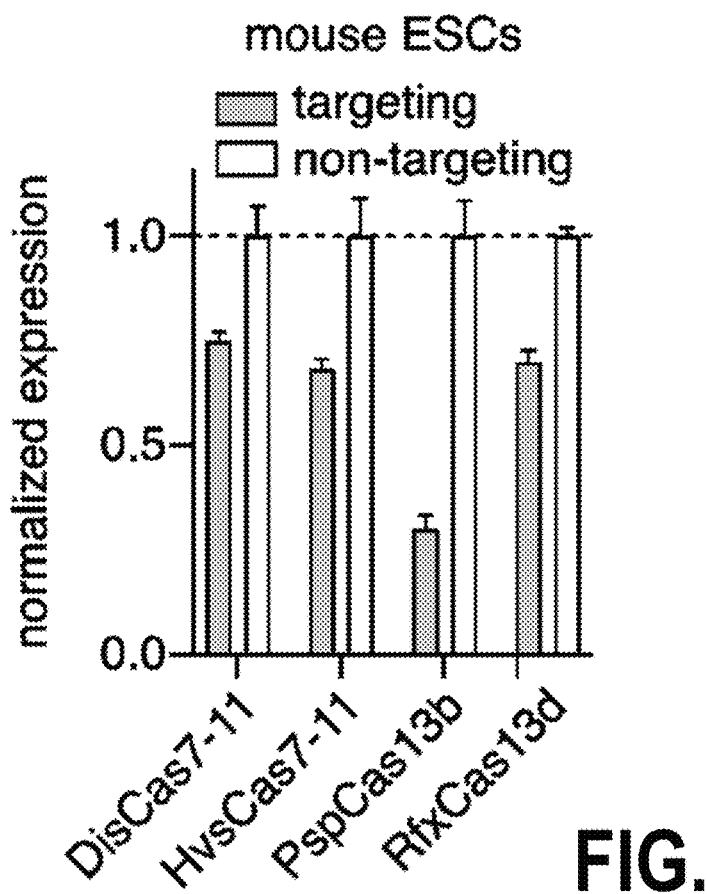
FIG. 8Z is a graph showing the knockdown activity in mouse embryonic stem cells (ESCs) of DisCas7-11, HvsCas7-11, PspCas13b, and RfxCas13d against the Gaussia luciferase (Gluc) transcript normalized to corresponding non-targeting controls according to embodiments of the present teachings.
Figure 8A:
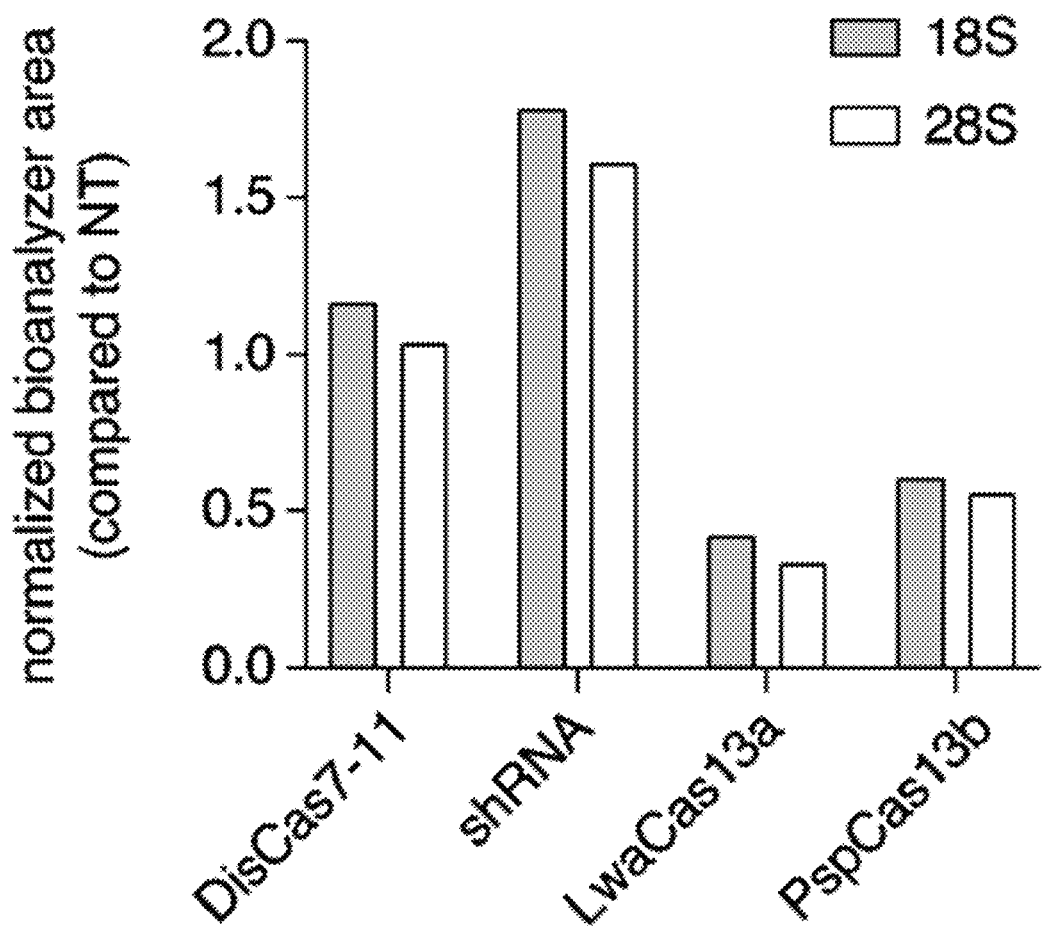
Figure 8A:
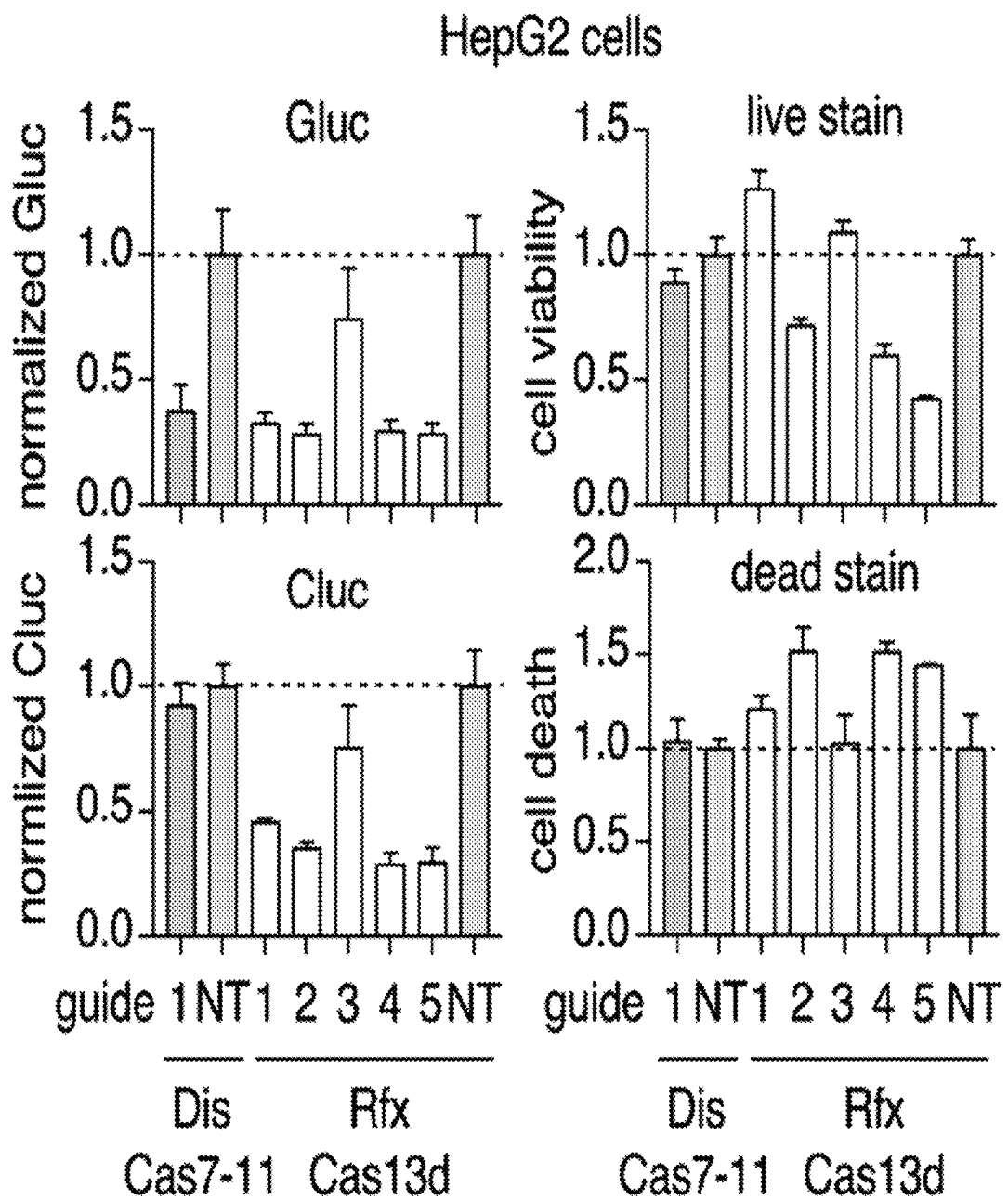
Figure 8A:
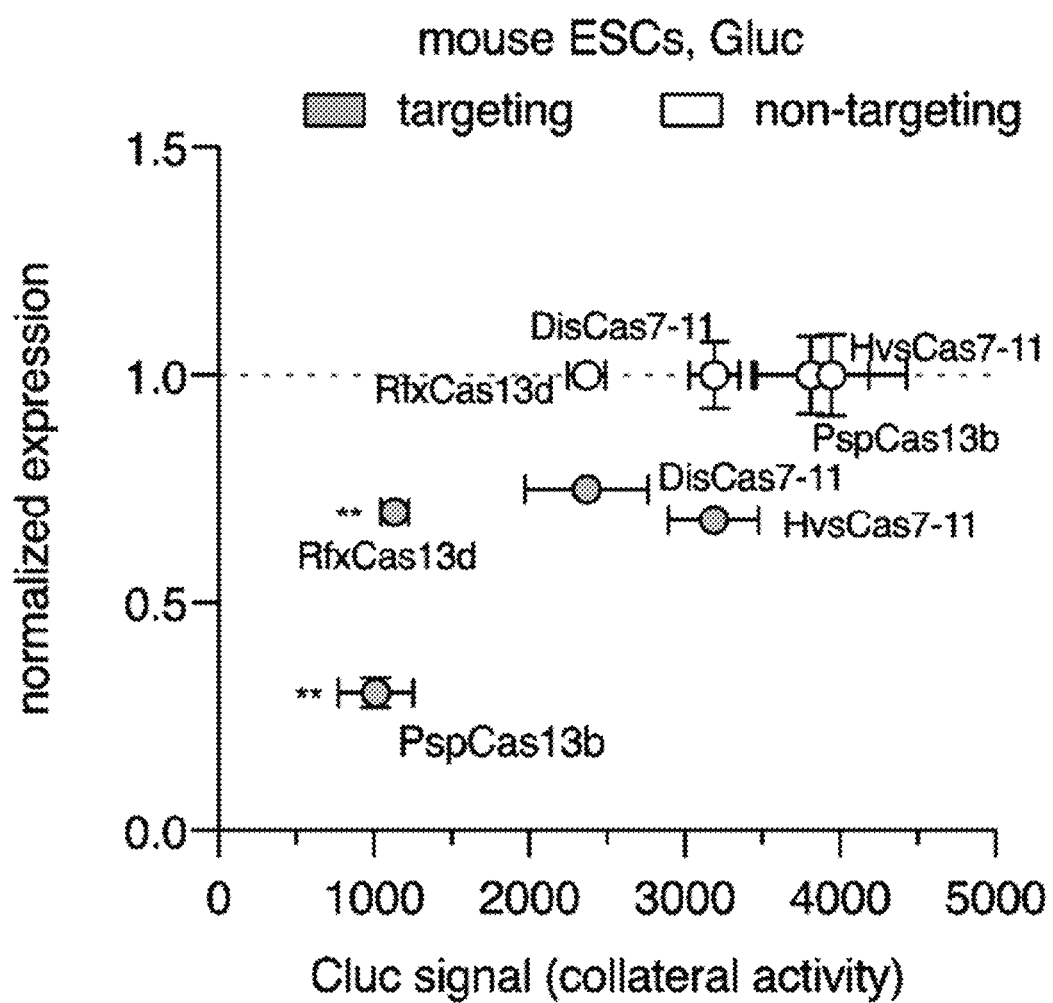

Given that DisCas7-11 lacked collateral activity in vitro or in vivo, the efficiency and effects of targeting with DisCas7-11, multiple Cas13 family members, and RNA interference through small hairpin RNA (shRNA) was compared. The activity in HEK293FT cells was assessed, for which no detectable growth impact from Cas13a targeting has been reported. Comparing Gluc knockdown between DisCas7-11, LwaCas13a, PspCas13b, RfxCas13d, and shRNA, comparable knockdown efficiencies was found for the different systems, with the exception of LwaCas13a, which could only reach ~35% knockdown (FIG. 8L). By assessing the specificities of the different systems by whole transcriptome profiling in HEK293FT cells and comparing between targeting and non-targeting guide conditions, it was found that there were more differentially expressed genes for shRNA and RfxCas13d than for DisCas7-11 (FIG. 8M). LwaCas13a and PspCas13b had minimal off-target effects on the transcriptome when comparing targeting versus non-targeting guide conditions, and none of these knockdown tools had any effect on HEK293FT cell viability (FIGS. 8M-8N). In addition, when comparing targeting conditions of the different tools to a no-protein, GFP condition, only RfxCas13d expression was found to result in detectable differential gene expression. Because cell toxicity of Cas13 has been reported in certain cell types, such as the U87 glioblastoma cell line7, the degree of toxicity due to the collateral activity of Cas13 may be cell-type specific. Thus, the comparison of shRNA, Cas13a/b/d, and Cas7-11 knockdown activities was repeated in U87 cells, finding efficient knockdown by DisCas7-11, PspCas13b, and RfxCas13d, less efficient knockdown with LwaCas13a, and no activity from shRNA (FIG. 8O). Whereas DisCas7-11 and the Cas13 variants showed minimal differential gene expression off-targets when comparing between targeting and non-targeting conditions, evaluation of targeting conditions versus the no protein, GFP-only control showed increased numbers of differentially expressed genes in RfxCas13d, LwaCas13a, and PspCas13b compared to DisCas7-11 (FIG. 8P). Moreover, Cas13 enzymes and shRNA caused cell toxicity resulting in ~30-50% cell death, whereas DisCas7-11 expression had minimal impact on cell viability (FIG. 8Q), consistent with the specific knockdown demonstrated by transcriptome sequencing. The observation that certain cell lines can be more susceptible to non-specific RNA degradation than others is consistent with other reports on substantial RNAi toxicity in diverse cell lines. Moreover, the ineffectiveness of the RNAi constructs in U87 cells herein, in contrast to their functionality in HEK293FT cells, is consistent with the low Dicer and Argonaute 2 expression in U87 cells, causing poor on-target knockdown, with off-target induced toxicity. The highly specific and low toxicity knockdown activity of DisCas7-11 compared to other RNA knockdown tools, RNAi and Cas13, could make Cas7-11 proteins more generally applicable and appropriate tools for RNA knockdown across diverse cells and tissues.

Example 8

Heterologous Expressions of Type-III-E CRISPR Cas System

Figure 9A:
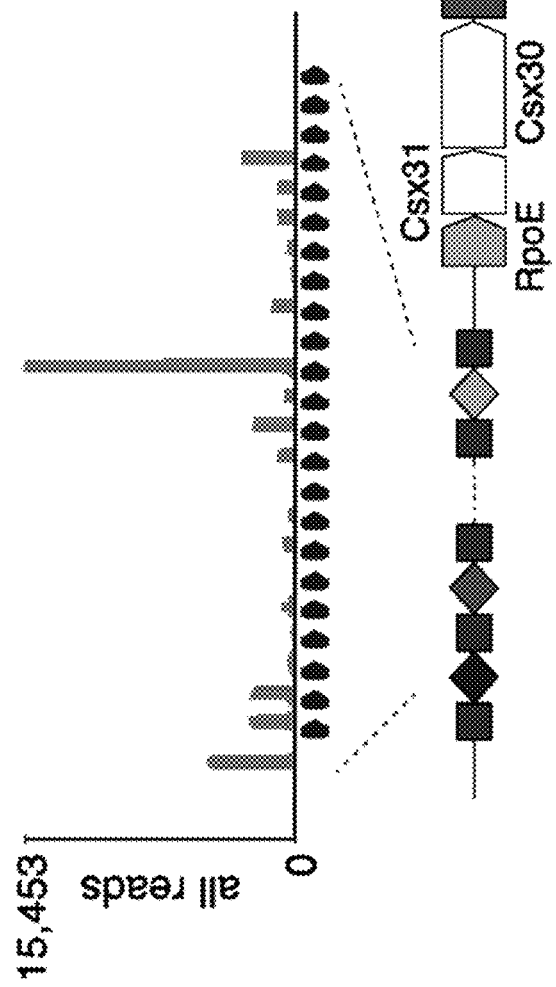
FIG. 9A illustrates the *Desulfonema ishimotonii* Type III-E full locus matures crRNAs in *E. coli* according to embodiments of the present teachings.
Figure 9B:
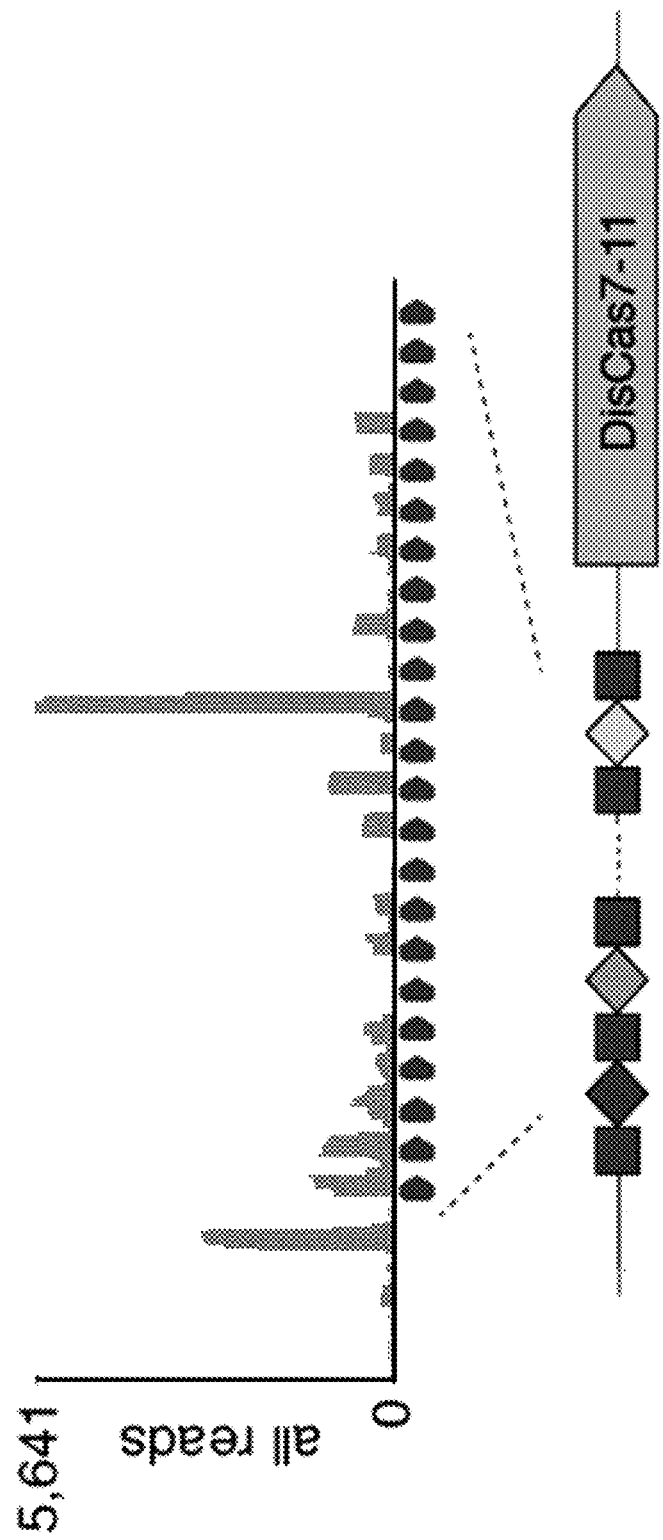
FIG. 9B illustrates the single effector protein DisCas7-11 matures crRNAs in *E. coli* according to embodiments of the present teachings.
Figure 9C:
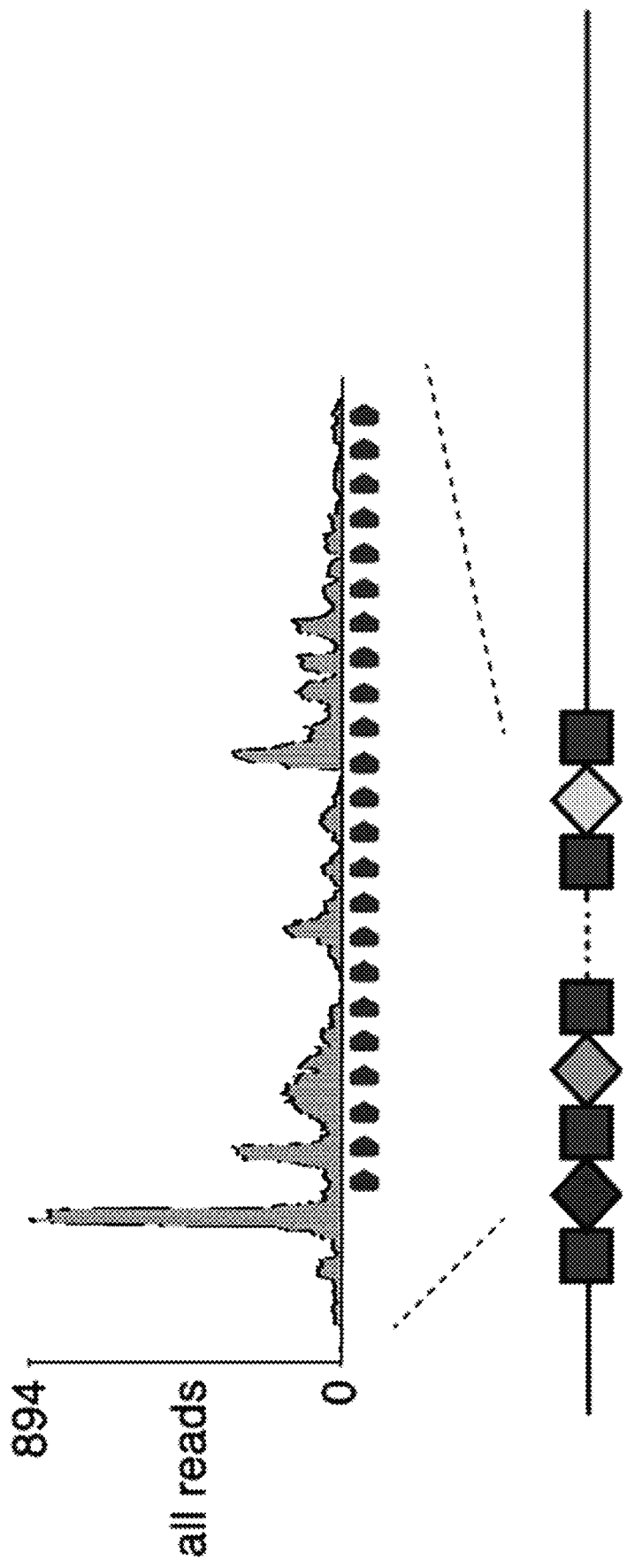
FIG. 9C illustrates the expression of the DisCas7-11 CRISPR array without any effector or accessory proteins according to embodiments of the present teachings.
Figure 9D:
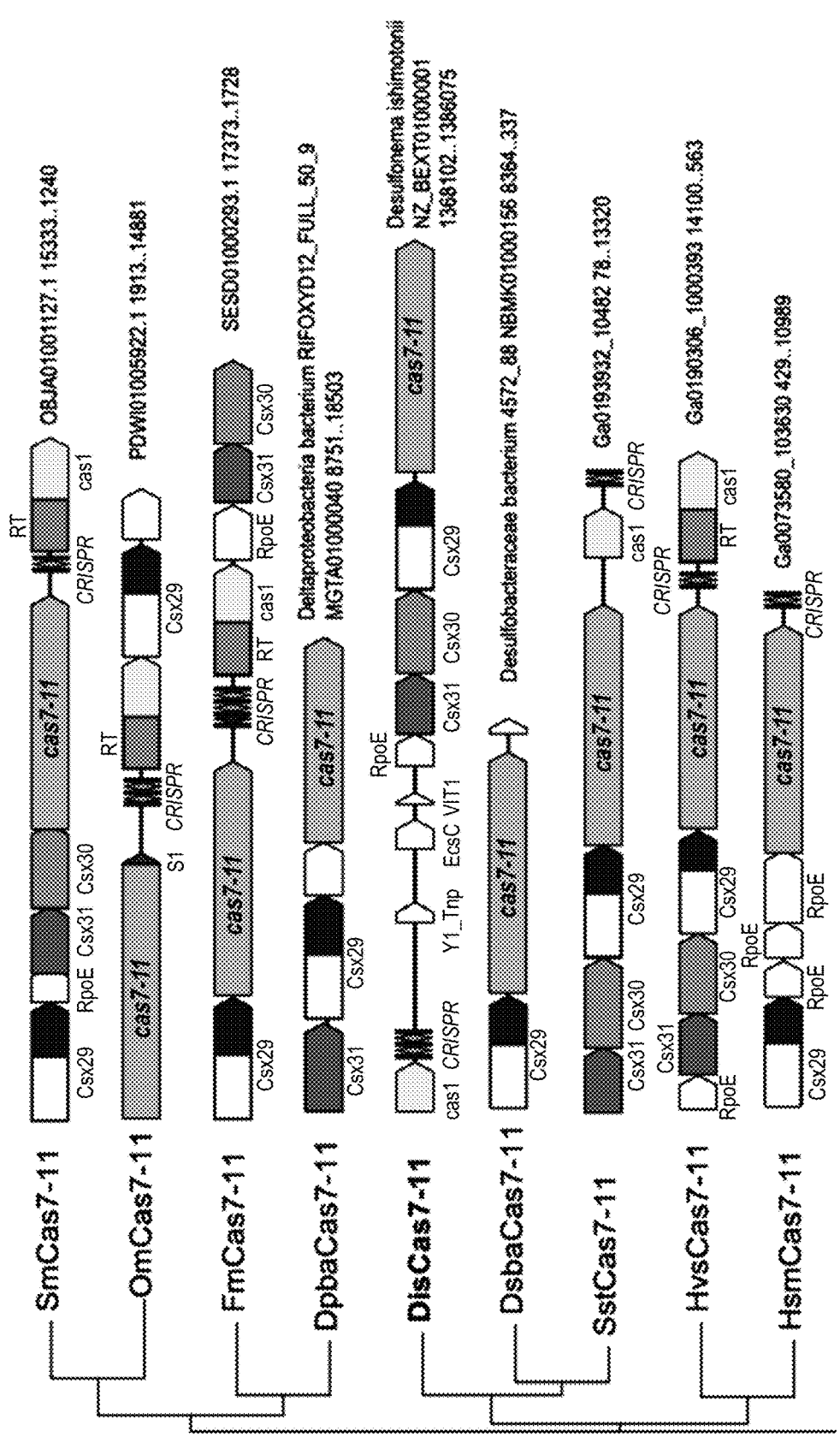
FIG. 9D illustrates types III-E and III-D2 loci containing Cas7-11 and Cas7×3 respectively according to embodiments of the present teachings.
Figure 9D:
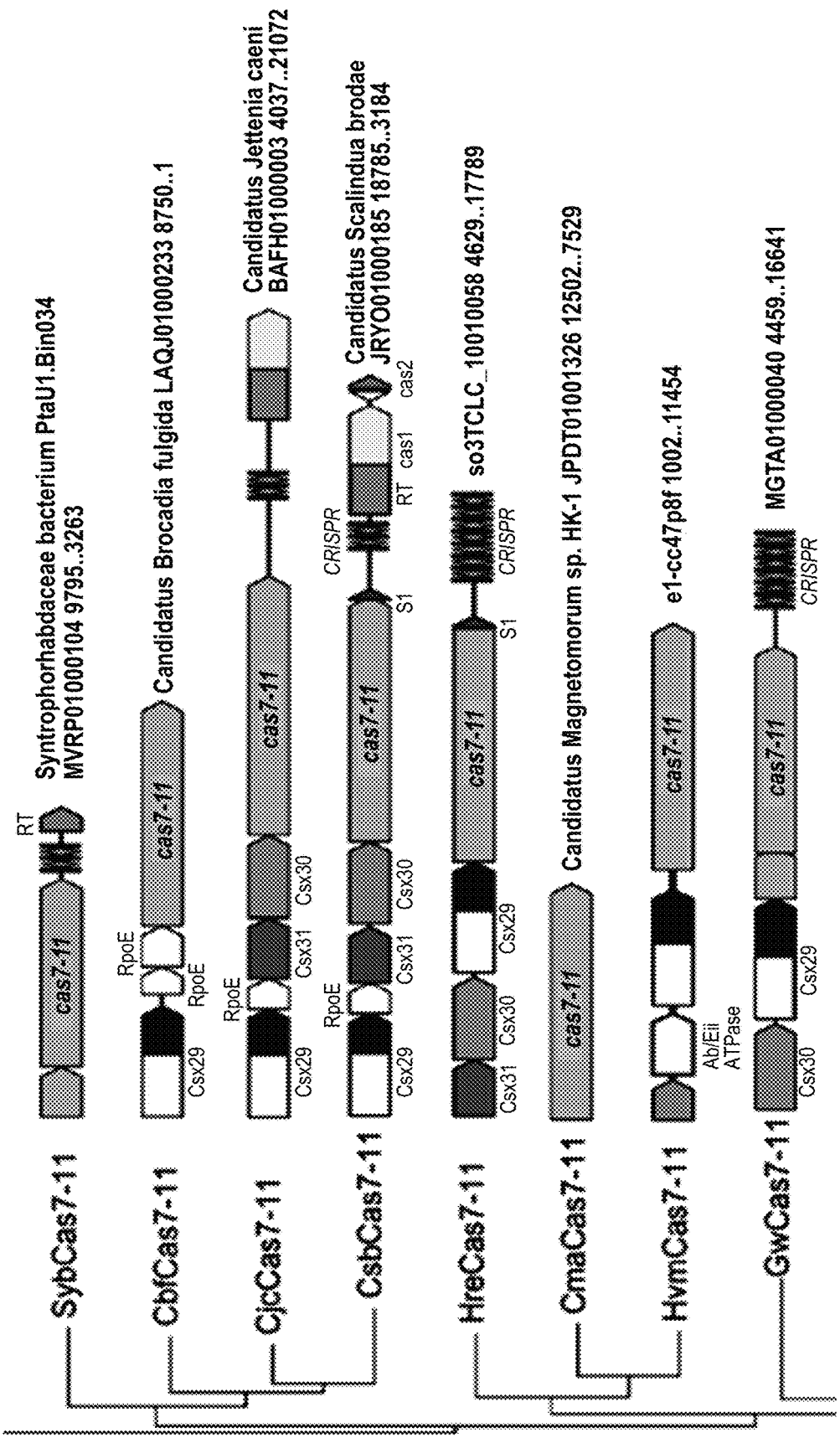
Figure 9D:
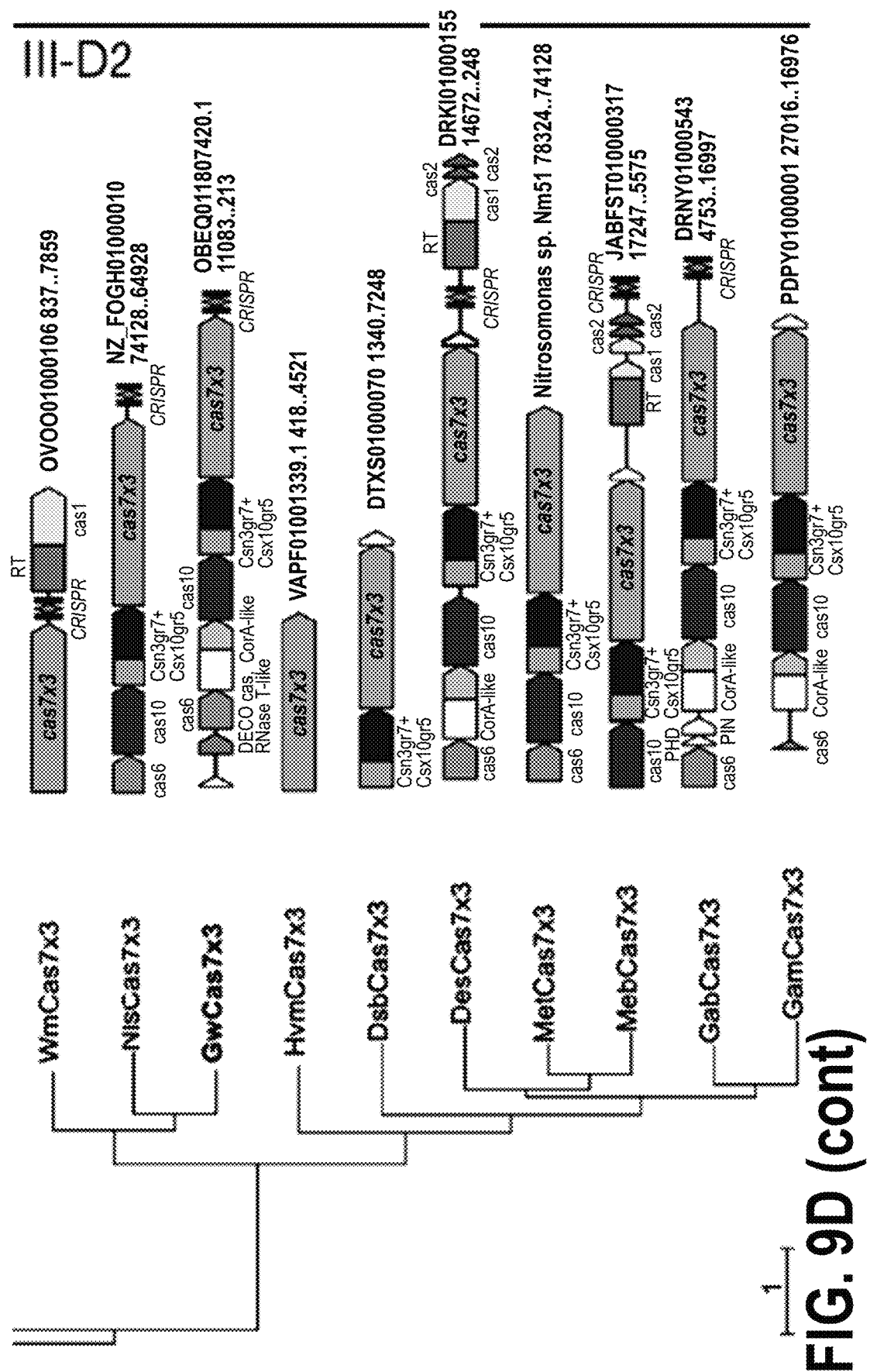

The heterologous expression of the *Desulfonema ishimotonii* Type III-E CRISPR-Cas system and associated CRISPR array were performed. The *Desulfonema ishimotonii* Type III-E full locus matures crRNAs (FIG. 9A), single effector protein DisCas7-11 matures crRNAs in *E. coli*. (FIG. 9B) and DisCas7-11 CRISPR array without any effector or accessory proteins (FIG. 9C) were expressed. Additional type III-E family members and loci architecture are illustrated in FIG. 9D.

Example 9

Cas7-11 Dilution Assays

Figure 10:
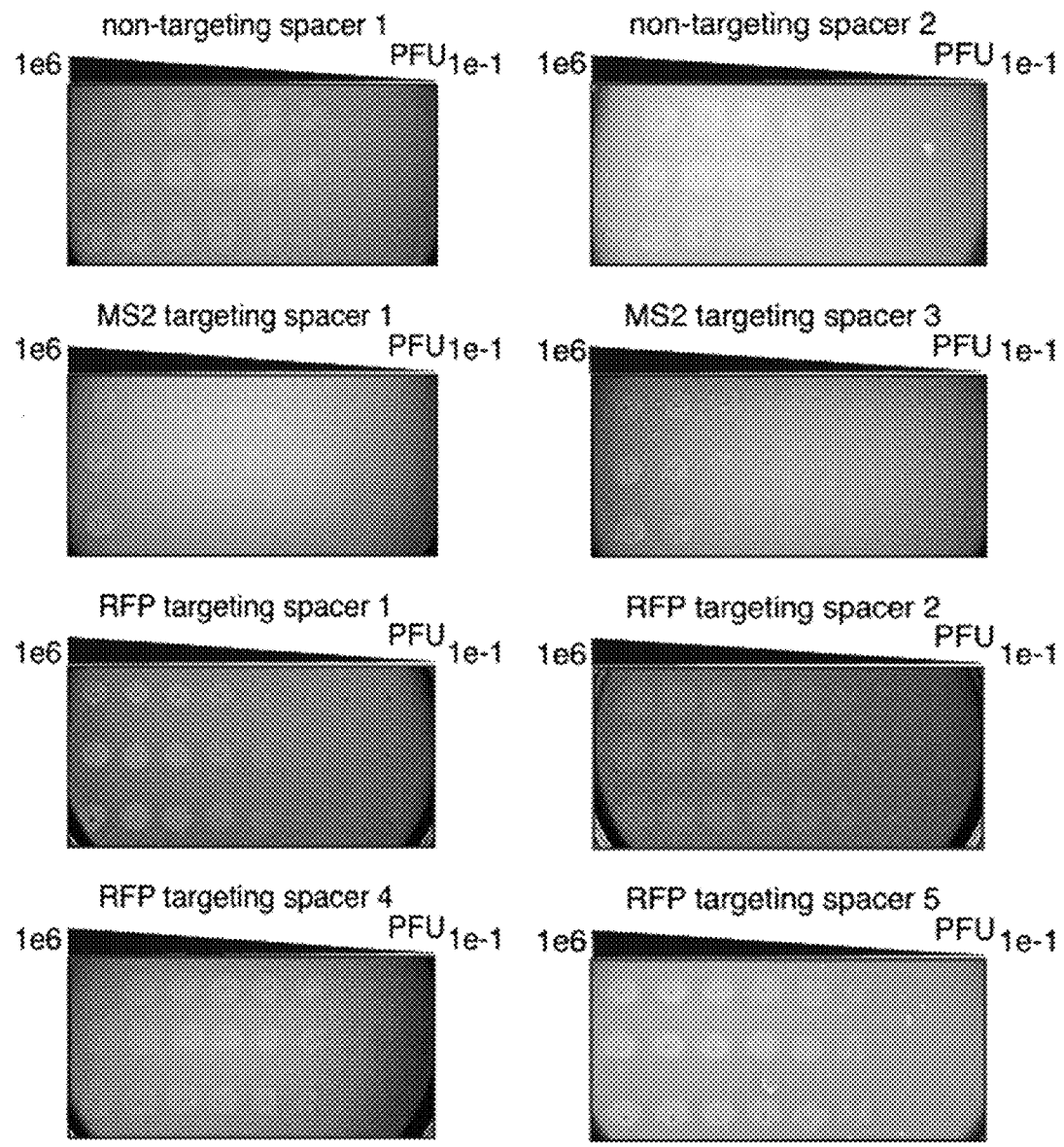
FIG. 10 are images of MS2 plaque dilution assays for MS2 targeting spacers, non-targeting spacers and RFP targeting spacers with DisCas7-11 according to embodiments of the present teachings.

Dilution assays with DisCas7-11 and different spacers were performed. The DisCas7-11 assays for MS2 targeting spacers, non-targeting spacers and RFP targeting spacers were performed with dilution of phage up to 1e-1 (FIG. 10). The assay shows that bacteria with DisCas7-11a and MS2 targeting guides can survive at higher viral loads Example 10

Effects Genes on MS2 Interference

Figure 11C:
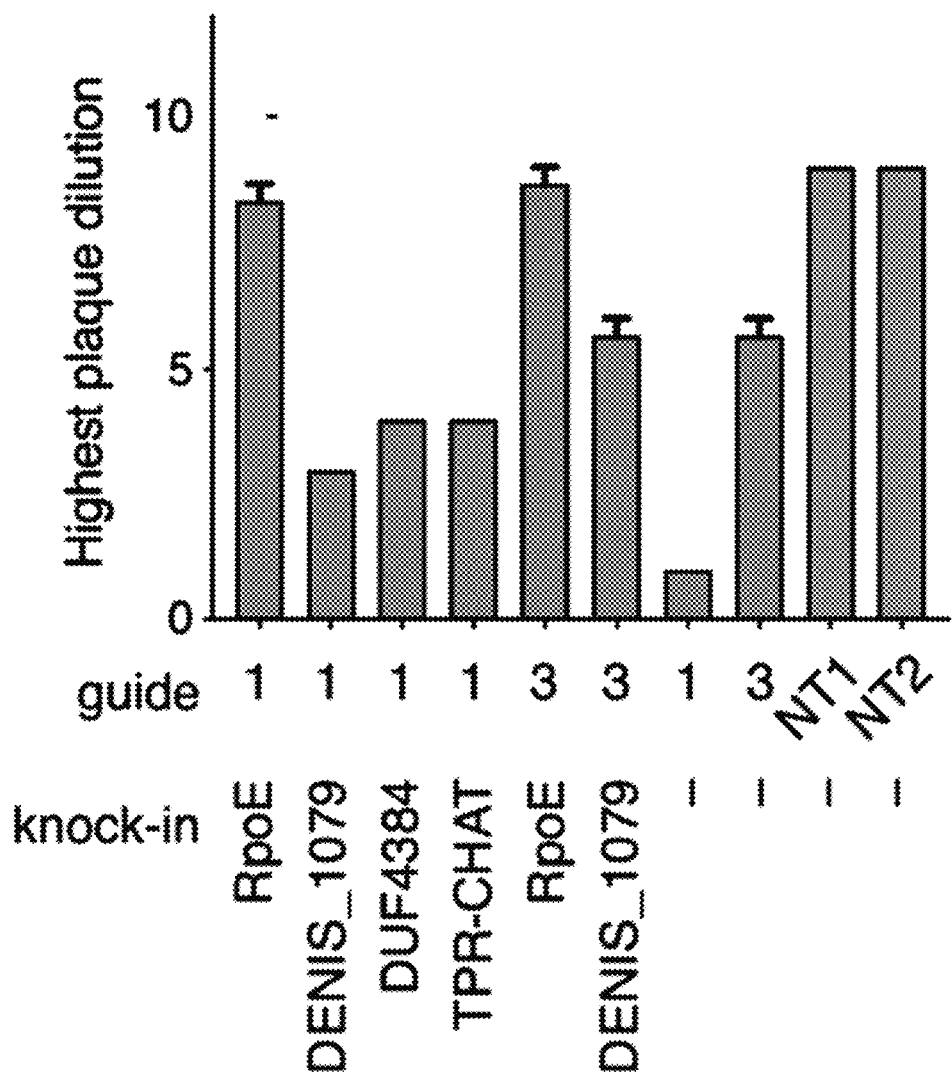
FIG. 11C is a diagram showing the phage plaque assay of the individual gene knock-in together with of the Type III-E DisCas7-11 CRISPR-Cas system according to embodiments of the present teachings.

The effects of genes in the *Desulfonema ishimotonii* type III-E CRISPR-Cas locus on MS2 interference were analyzed. The Type III-E locus of the *Desulfonema ishimotonii* is illustrated in FIG. 11A. Results of the phage plaque assay of the incomplete Type III-E DisCas7-11 CRISPR-Cas locus are shown in FIG. 11B. The knock-out of TPR-CHAT shows the highest positive effect on the interference by DisCas7-11. Results from the phage plaque assay of the individual gene knock-in together with of the Type III-E DisCas7-11 CRISPR-Cas system are shown in FIG. 11C. Knock-in data shows that RpoE has an inhibitory effect on DisCas7-11.

Example 11

Cas7-11 Pre-crRNA Processing to DR Mutations

Figure 12A:
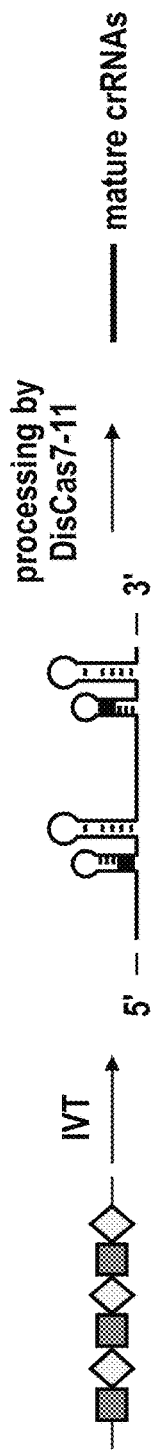
FIG. 12A illustrates the in vitro transcription of pre-crRNA and processing by DisCas7-11 according to embodiments of the present teachings.
Figure 12B:
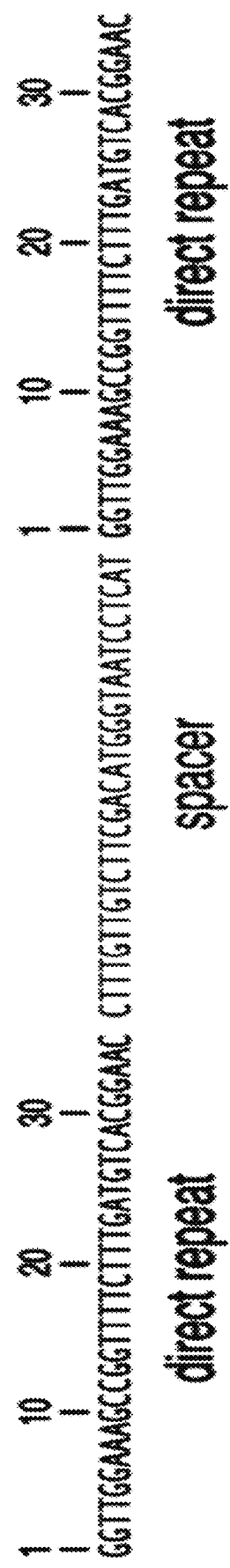
FIG. 12B is a sequence of a single spacer CRISPR array showing locations of mutated bases according to embodiments of the present teachings. Figure discloses SEQ ID NO: 641.

The robustness of DisCas7-11 pre-crRNA processing to DR mutations was evaluated. The in vitro transcription of pre-crRNA and processing by DisCas7-11 is illustrated in FIG. 12A. The sequence of a single spacer CRISPR array showing locations of mutated bases is shown in FIG. 12B.

Figure 12C:
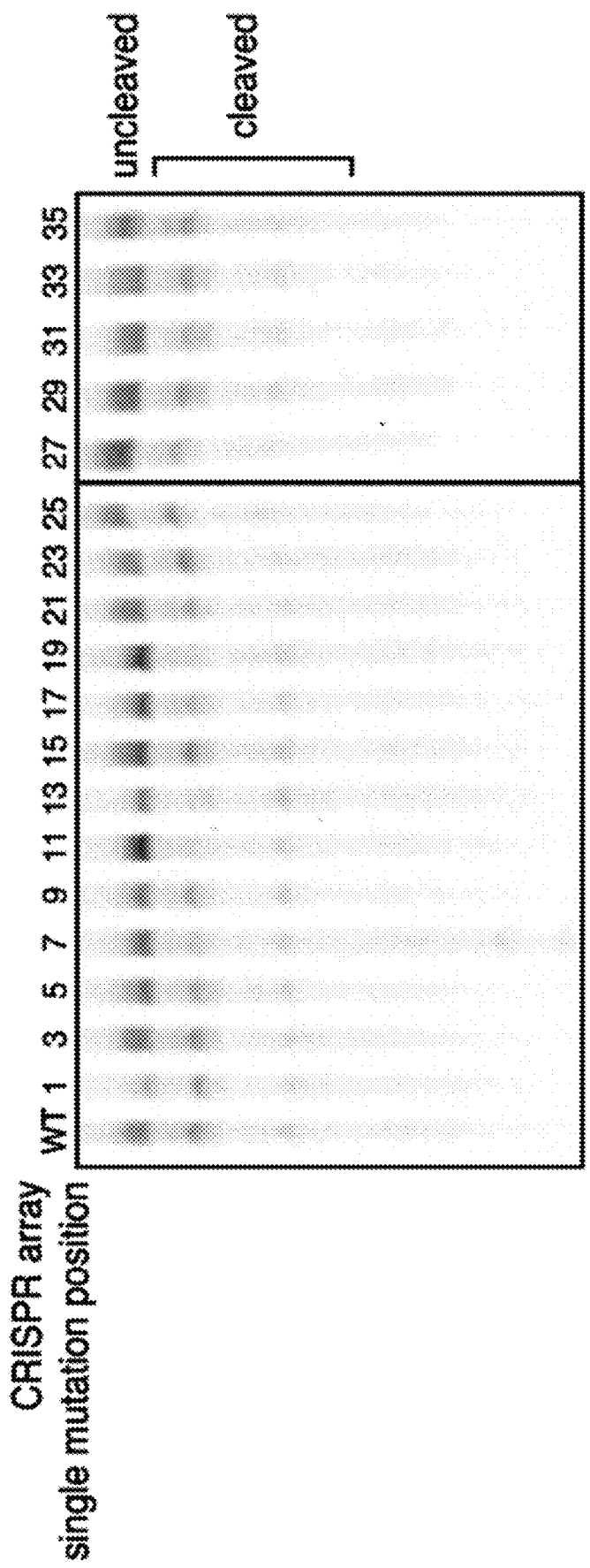
FIG. 12C is an image of the processing of transcribed pre-crRNA showing the effect of single position mutations on processing according to embodiments of the present teachings.

The transcribed pre-crRNA was processed and the results showed the effect of consecutive double mutations on processing (FIG. 12C). Transcribed pre-crRNA was processed and the results showed the effect of consecutive double mutations on processing (FIG. 12D).

Example 12

Effect of Ion on Cas7-11 Activity

Figure 13A:
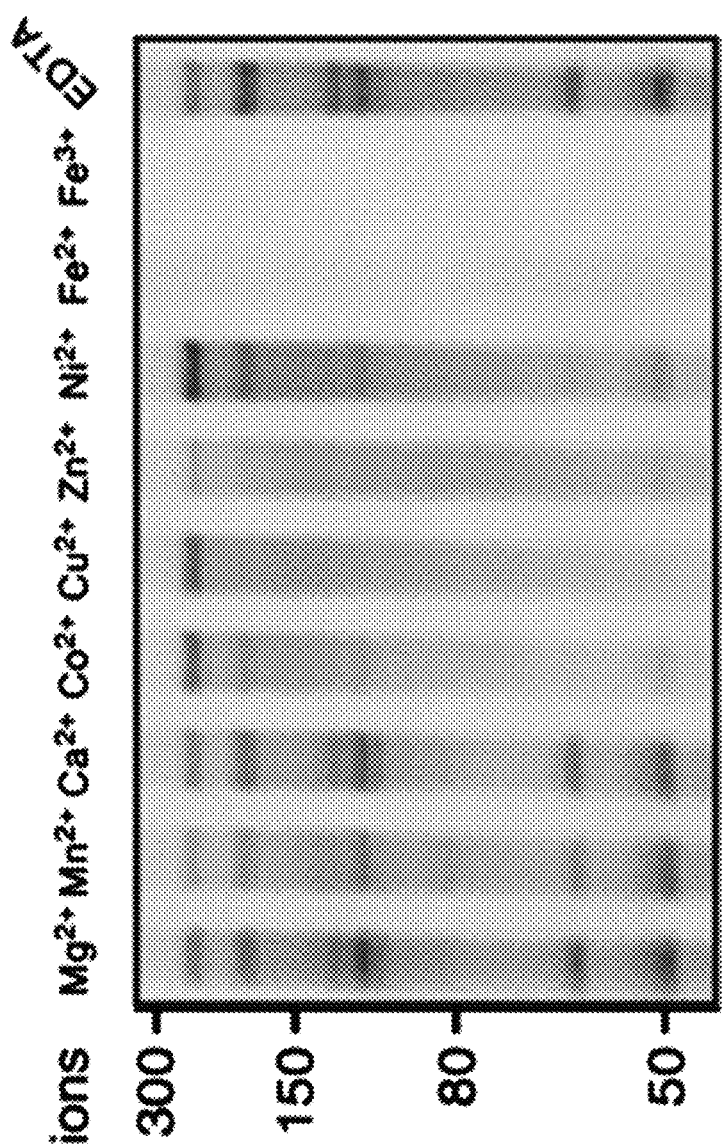
FIG. 13A illustrates the processing of pre-crRNA by DisCas7-11 in the presence of different ions or chelating agents according to embodiments of the present teachings.
Figure 13D:
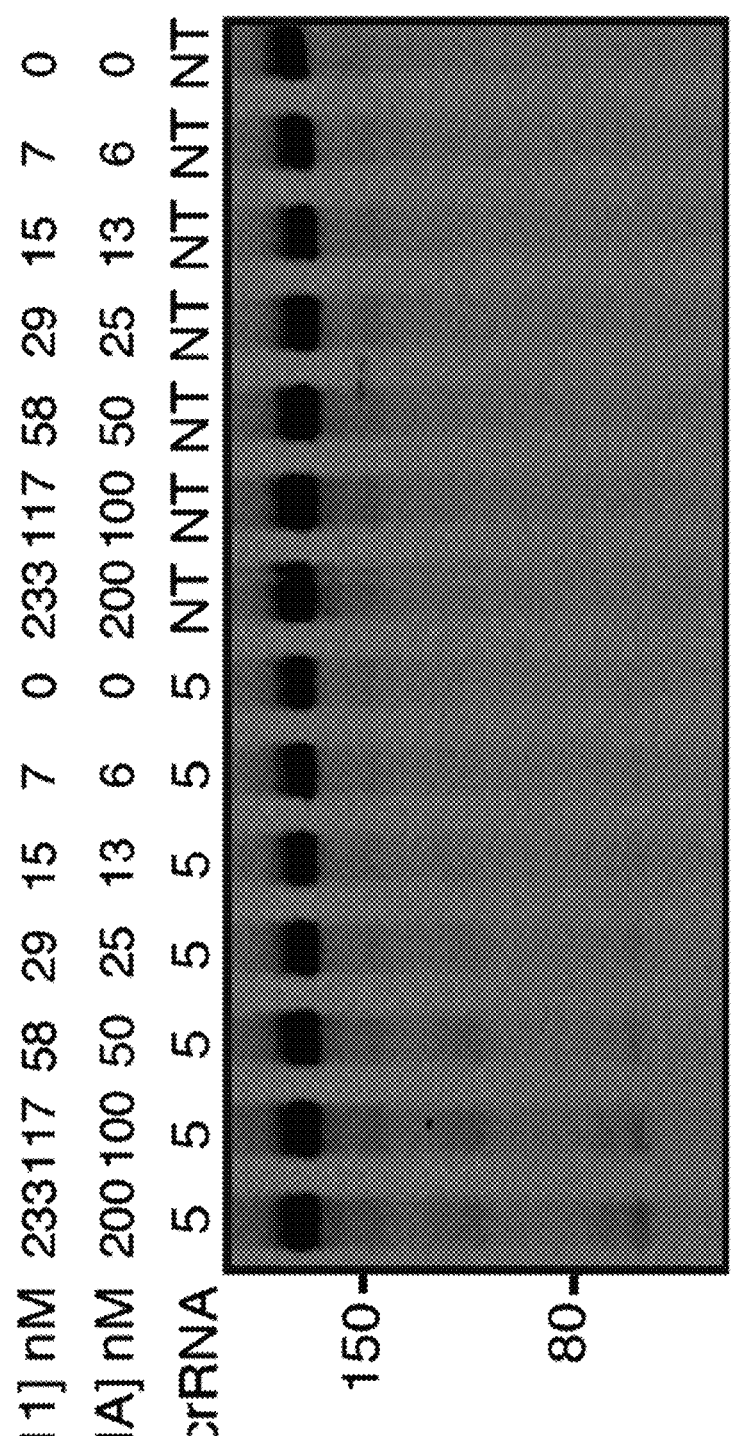
FIG. 13D illustrates the cleavage of ssRNA target with increasing amounts of DisCas7-11-crRNA complex from 0 nM to 233 nM according to embodiments of the present teachings.
Figure 13E:
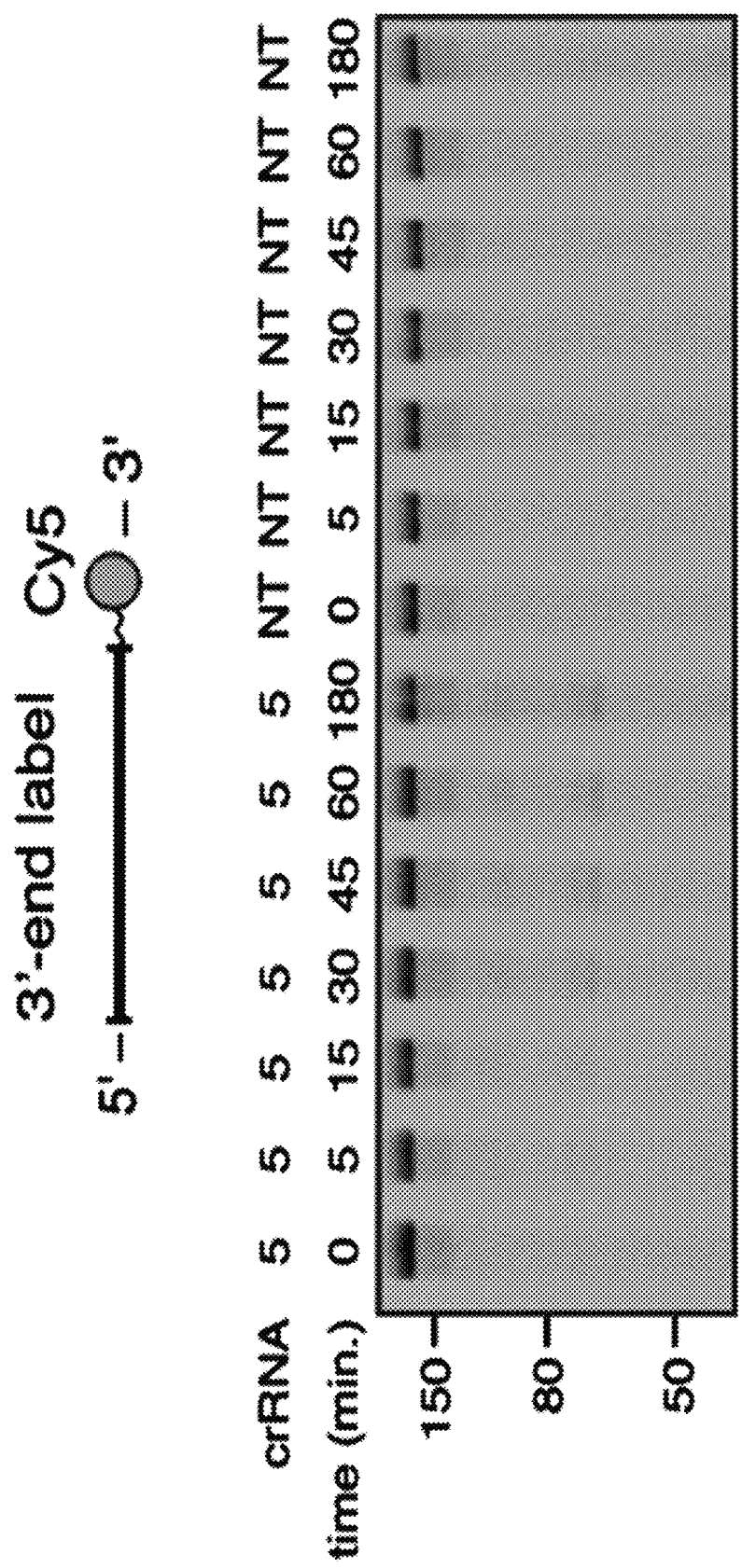
FIG. 13E illustrates the cleavage of ssRNA target at increasing incubation periods from 0 minutes to 180 minutes according to embodiments of the present teachings.

The effects of ions on pre-crRNA processing and ions, complex concentrations, and incubation time on target cleavage was analyzed. The in vitro transcription and 5' end labeling of pre-crRNA and processing by DisCas7-11 were assessed. Pre-crRNA was processed by DisCas7-11 in the presence of different ions or chelating agents (FIG. 13A). CRISPR array processing by DisCas7-11 is shown to be ion independent. A schematic of in vitro cleavage of ssRNA target with DisCas7-11 and crRNA 5 is shown in FIG. 13B. The ssRNA target was incubated with DisCas7-11 and targeting or non-targeting crRNA in the presence of different ions or chelating agents (FIG. 13C). The results show the dependence on magnesium, manganese, and calcium. The cleavage of ssRNA target with increasing amounts of Dis-Cas7-11-crRNA complex from 0 nM to 233 nM was performed (FIG. 13D). The cleavage of ssRNA target at increasing incubation periods from 0 minutes to 180 minutes was also performed (FIG. 13E).

Example 13

Effect of DR Length, Spacer Length and DR Mutations on Cas7-11 Activity

Figures 14C, 14D:
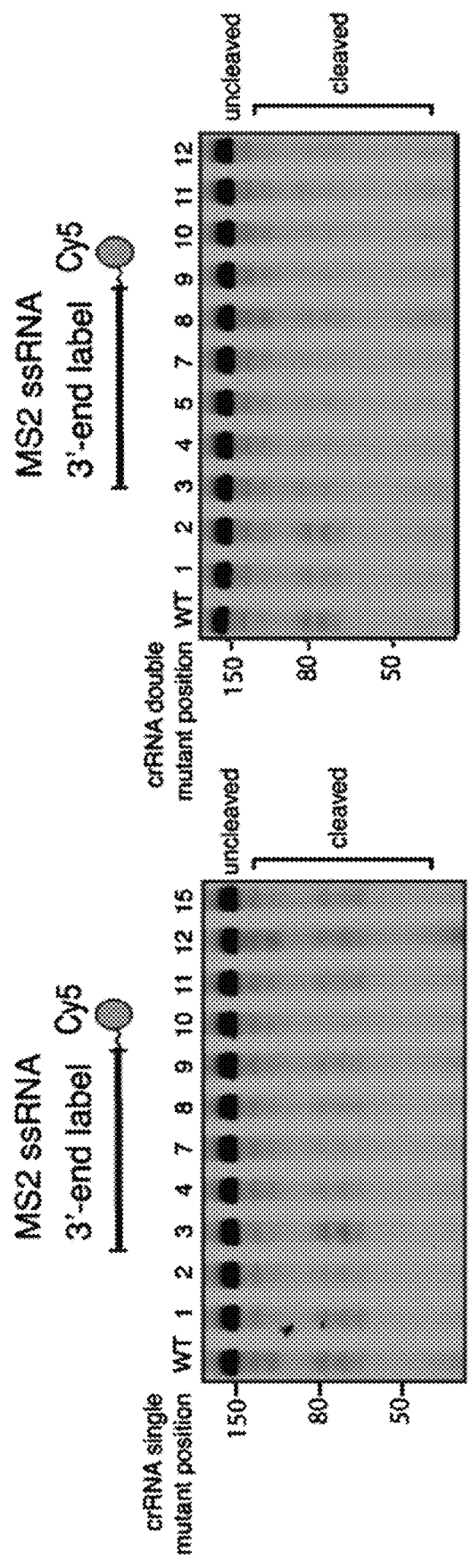
FIG. 14C is a sequence of DisCas7-11 crRNA 1 targeting the MS2 target according to embodiments of the present teachings. Figure discloses SEQ ID NO: 643.
FIG. 14D illustrates the cleavage of the MS2 target according to embodiments of the present teachings.

The effects of DR length, spacer length, and DR mutations on in vitro target cleavage by DisCas7-11 were evaluated. A schematic of the sequence of DisCas7-11 crRNA 5 targeting the ssRNA target is shown in FIG. 14A. The ssRNA target was cleaved with crRNA of varying DR and spacer lengths (FIG. 14B). A schematic of the sequence of DisCas7-11 crRNA 1 targeting the MS2 target is shown in FIG. 14C. The MS2 ssRNA target was cleaved (FIG. 14D). The results show the effect of single and double mutations at various positions in the DR, and several single and double mutations cause inhibition of DisCas7-11 target cleavage.

Example 14

DisCas7-11 In Vivo Collateral Activity

Figure 15:
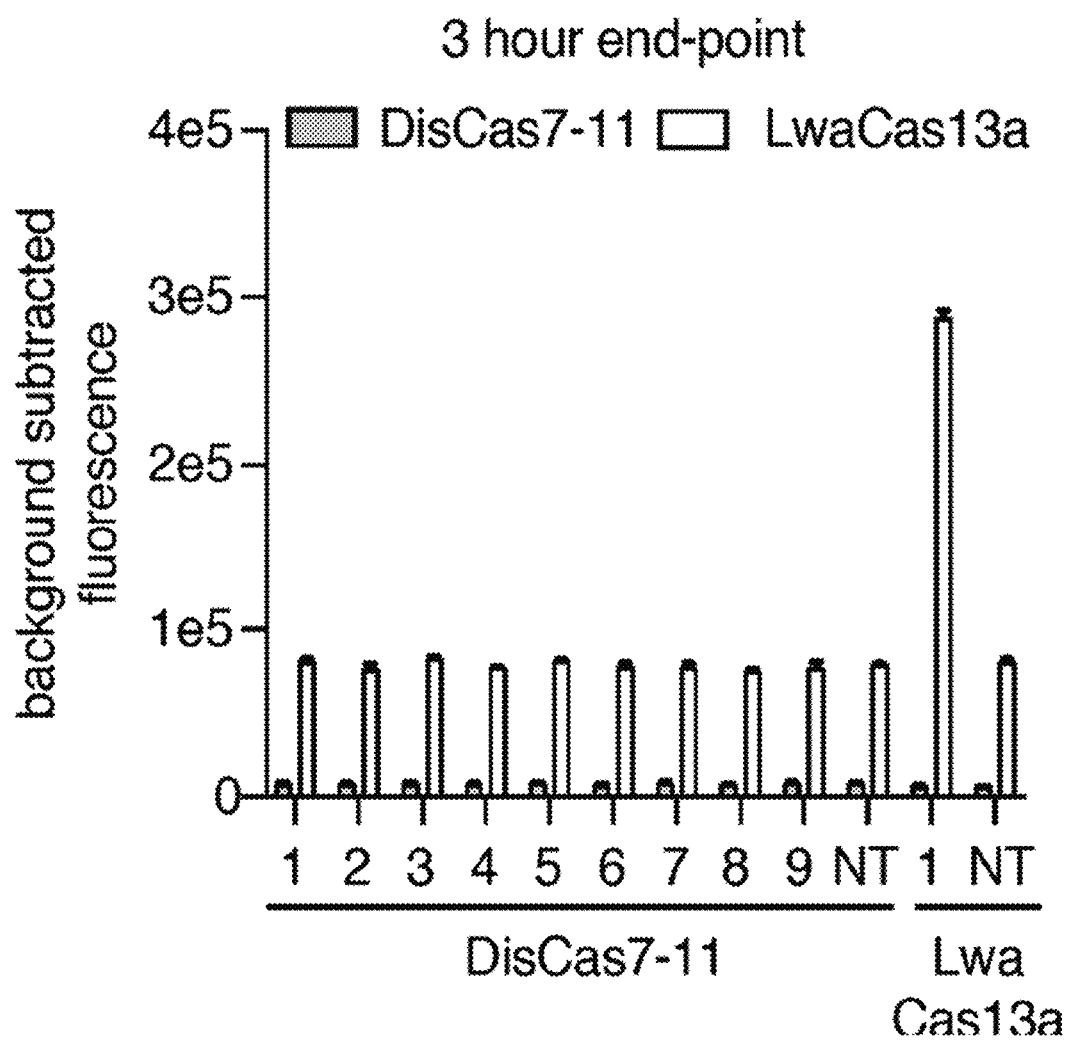
FIG. 15 is a diagram of the fluorescence of RnaseAlert reporter incubated with either DisCas7-11 or LwaCas13a targeting and non-targeting guides against MS2 ssRNA target according to embodiments of the present teachings.

The in vivo collateral activity of DisCas7-11 was evaluated. The results from the three-hour end point fluorescence of RnaseAlert reporter incubated with either DisCas7-11 or LwaCas13a targeting and non-targeting guides against MS2 ssRNA target are shown in FIG. 15. The LwaCas13a demonstrates robust collateral activity whereas DisCas7-11 has no collateral cleavage of the RNase alert reporter.

Example 15

Activity of DisCas7-11 Catalytic Mutants

Figure 16A:
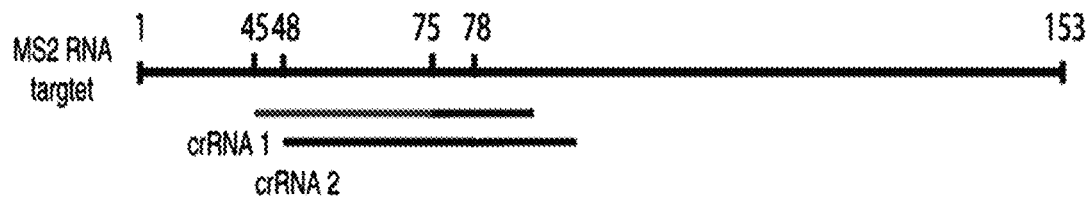
FIG. 16A is a schematic showing positions of DisCas7-11 crRNA 1 and crRNA 2 targeting the MS2 target according to embodiments of the present teachings.
Figure 16B:
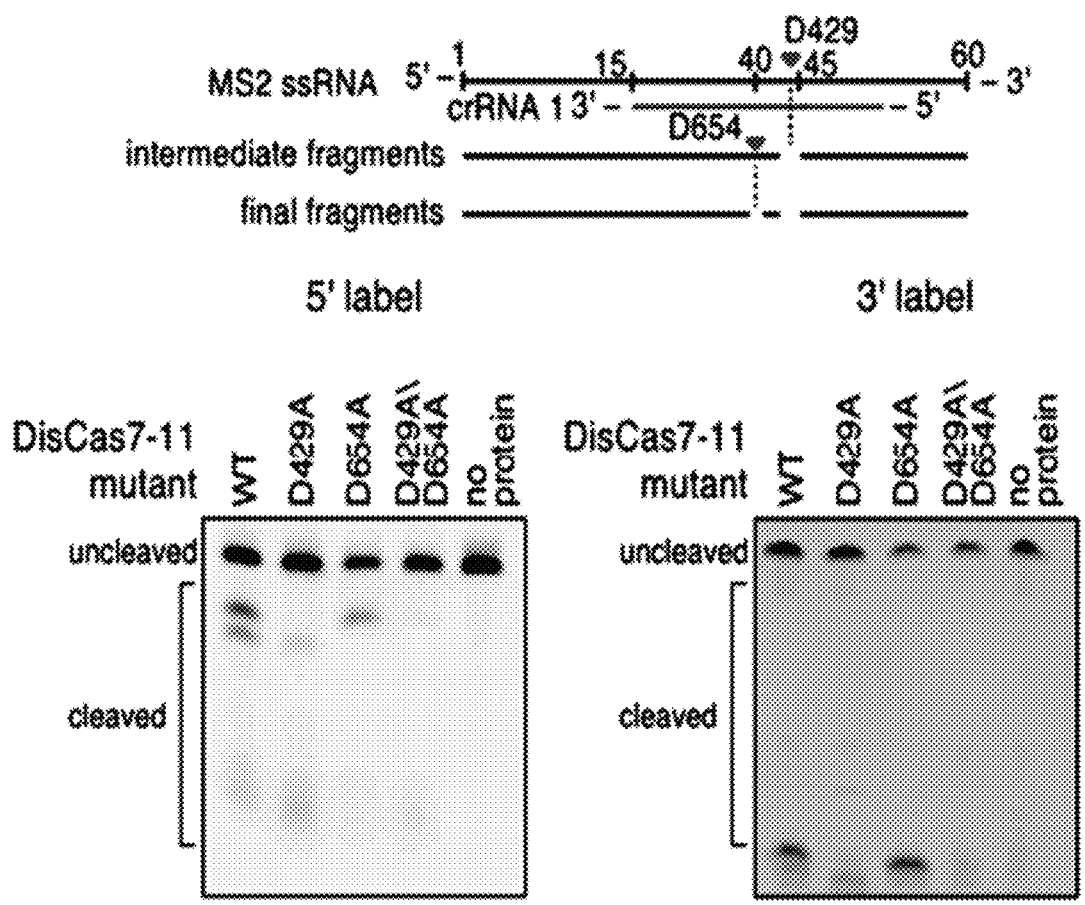
FIG. 16B illustrates the cleavage of a synthetic MS2 ssRNA target with two cRNAs and wild type, D429A, D654A, and D429A/D654A DisCas7-11 proteins according to embodiments of the present teachings.
Figure 17A:
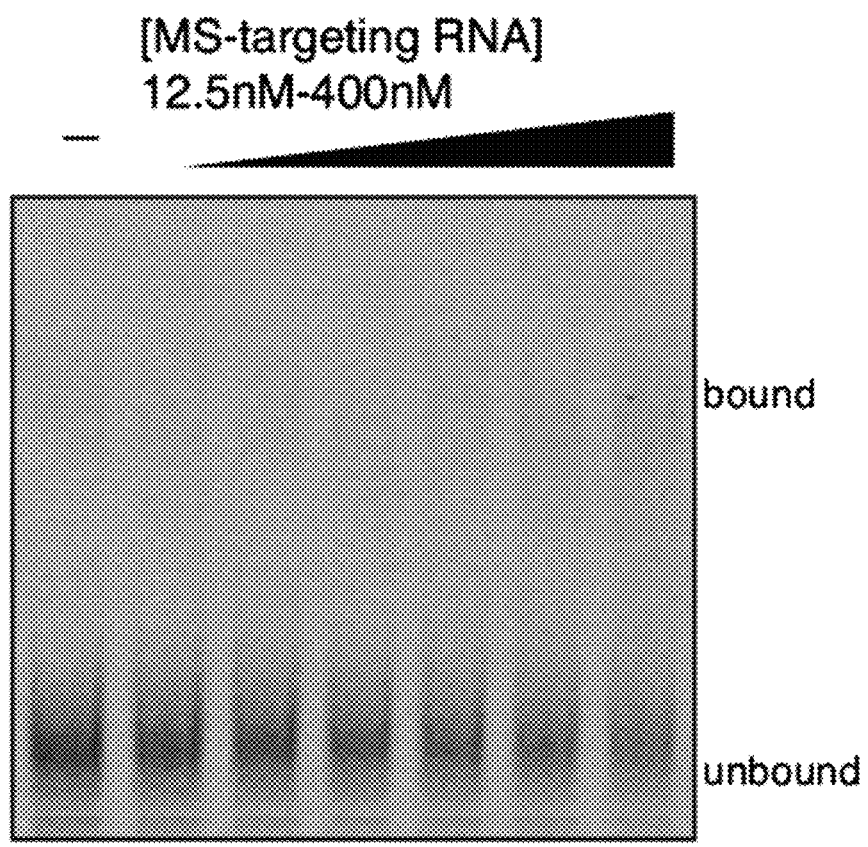
FIG. 17A illustrates an EMSA assay for targeting crRNA in the absence of DisCas7-11 according to embodiments of the present teachings.
Figure 17B:
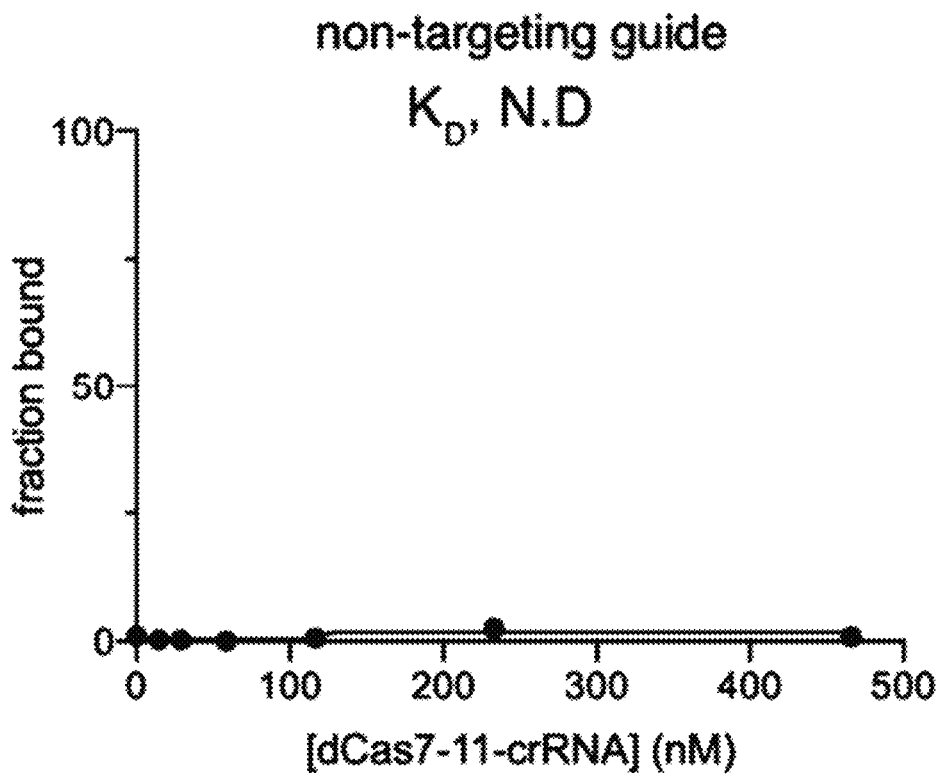
FIG. 17B illustrates the quantification of band intensities for EMSA gels according to embodiments of the present teachings.
Figure 17C:
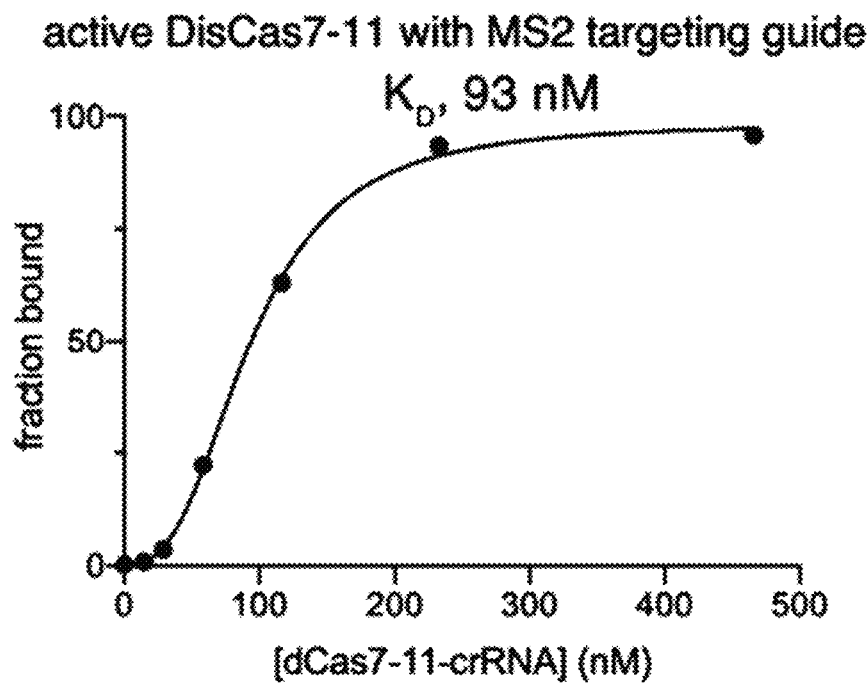
FIG. 17C illustrates the quantification of band intensities for EMSA gels according to embodiments of the present teachings.
Figure 17D:
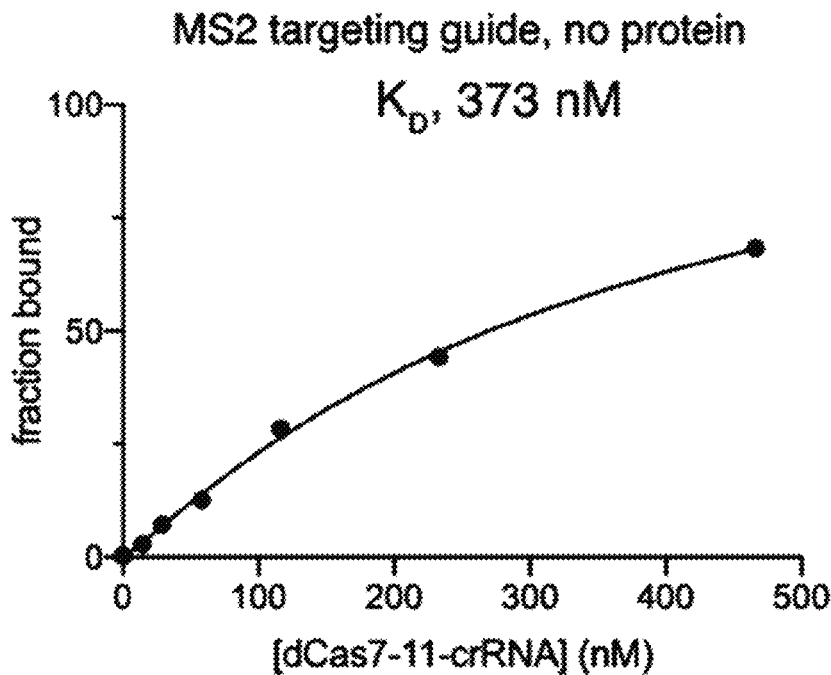
FIG. 17D illustrates the quantification of band intensities for EMSA gels according to embodiments of the present teachings.
Figure 17E:
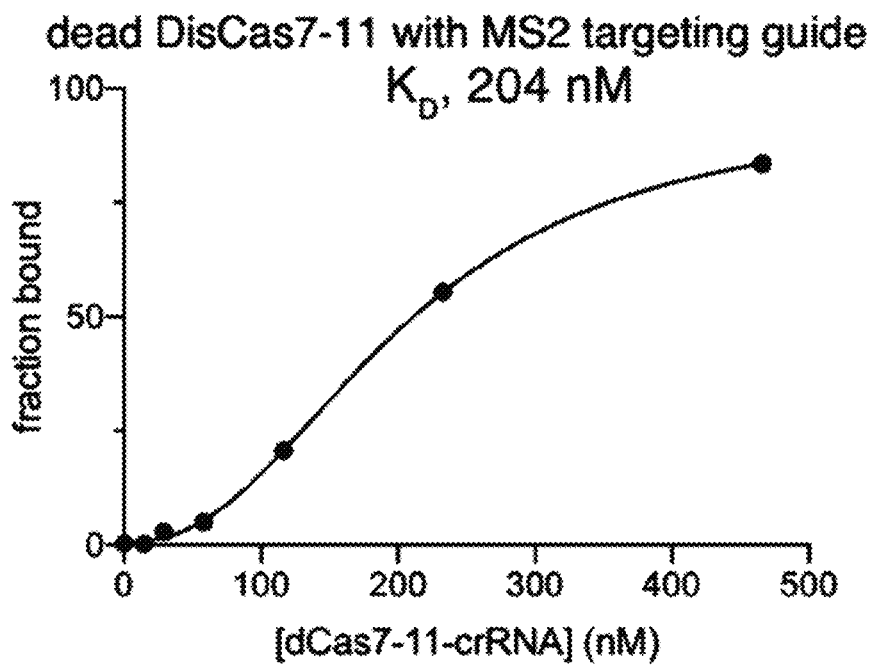
FIG. 17E illustrates the quantification of band intensities for EMSA gels according to embodiments of the present teachings.
Figure 17F:
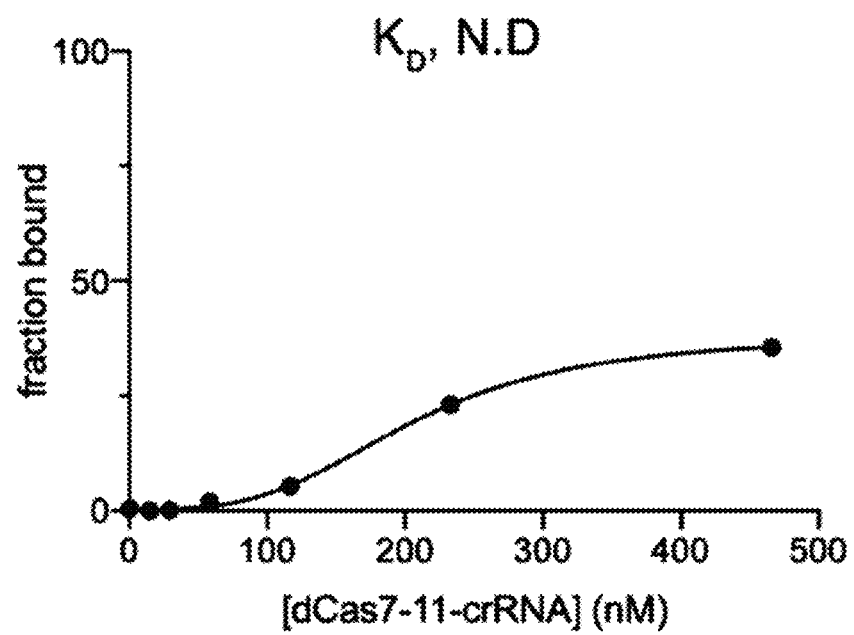
FIG. 17F illustrates the quantification of band intensities for EMSA gels according to embodiments of the present teachings.

The cleavage activity of DisCas7-11 catalytic mutants on MS2 RNA target was evaluated. A schematic showing the positions of DisCas7-11 crRNA 1 and crRNA 2 targeting the MS2 target is shown in FIG. 16A. The cleavage of a synthetic MS2 ssRNA target with two cRNAs and wild type, D429A, D654A, and D429A/D654A DisCas7-11 proteins was performed (FIG. 16B). The D429A/D654A mutant demonstrates reduced cleavage activity on the target.

The DisCas7-11 catalytic mutants that were assessed are presented in Table 16 below.

TABLE 16

| Mutation | In vitro status | Domain |
| --- | --- | --- |
| E70 | Purified, no effect | 1 |
| D77 | Purified, no effect | 1 |
| E93 | Purified, no effect | 1 |
| D111 | Purified, no effect | 1 |
| D143 | Purified, no effect | 1 |
| D160 | Purified, no effect | 1 |
| D162 | Purified, no effect | 1 |
| D177 | Purified, cut inactivated, bottom | 1 |
| D185 | Purified, no effect | 1 |
| D193 | Purified, no effect | 1 |
| D226 | Purified, no effect | 1 |
| D238 | Purified, no effect | 1 |
| E280 | Purified, no effect | 2 |
| D287 | Purified, no effect | 2 |
| W315 | Purified, no effect | 2 |
| D316 | Purified, no effect | 2 |
| D379 | Purified, no effect | 2 |
| E381 | Purified, no effect | 2 |
| E390 | Purified, no effect | 2 |
| D422 | Purified, no effect | 3 |
| D429 | Purified, cut inactivated, middle (top shifts up) | 3 |
| D437 | Purified, no effect | 3 |
| D454 | Purified, no effect | 3 |
| D487 | Purified, no effect | 3 |
| E497 | Purified, no effect | 3 |
| E520 | Purified, no effect | 3 |
| D543 | Purified, no effect | 3 |
| D581 | Purified, no effect | 3 |
| D642 | Purified, no effect | 4 |
| D654 | Purified, cut inactivated, bottom | 4 |
| D727 | Purified, no effect | 4 |
| D733 | Purified, no effect | 4 |
| D740 | Purified, no effect | 4 |
| D745 | Purified, cut inactivated, bottom | 4 |
| D753 | Purified, no effect | 4 |
| D758 | Purified, cut inactivated, bottom | 4 |
| D781 | Purified, no effect | 4 |
| D798 | Purified, no effect | 4 |
| D825 | Purified, no effect | 4 |
| D909 | Purified, no effect | 5 |
| D914 | Purified, no effect | 5 |
| E959 | Purified, cut inactivated, bottom | 5 |
| D970 | Purified, no effect | 5 |
| D982 | Purified, no effect | 5 |
| D998 | Purified, cut inactivated, bottom | 5 |
| D1015 | Purified, no effect | 5 |
| D1025 | Purified, no effect | 5 |
| D1118 | Purified, no effect | 5 |
| D1179 | Purified, no effect | 5 |
| D1273 | Purified, no effect | 5 |
| D1297 | Purified, no effect | 5 |
| D1308 | Purified, no effect | 5 |
| D1367 | Purified, no effect | 5 |
| D1404 | Purified, no effect | 5 |
| D1539 | Purified, no effect | 5 |
| D1569 | Purified, no effect | 5 |
| D1588 | Purified, no effect | 5 |

Example 16

Cas7-11 EMSA Binding Assays

Electrophoretic mobility shift assays (EMSA) for crRNA-target interactions and quantification of EMSA intensities were performed (FIGS. 17A-F). The EMSA assays for targeting crRNA in the absence of DisCas7-11 show minimal binding of the cRNA and shift of the labeled target). Target binding was found to be crRNA-dependent, as expected, and the dead mutant to have a similar affinity to ssRNA as the active DisCas7-11 protein. Furthermore, agreeing with the lack of ssDNA cleavage, DisCas7-11 showed weak ssDNA binding, and efficient binding required the full protein complexed with a.

Example 17

DisCas7-11 Cleavage Sites on ssRNA Targets

The characterization of DisCas7-11 cleavage sites on ssRNA targets was performed.

Figure 18A:
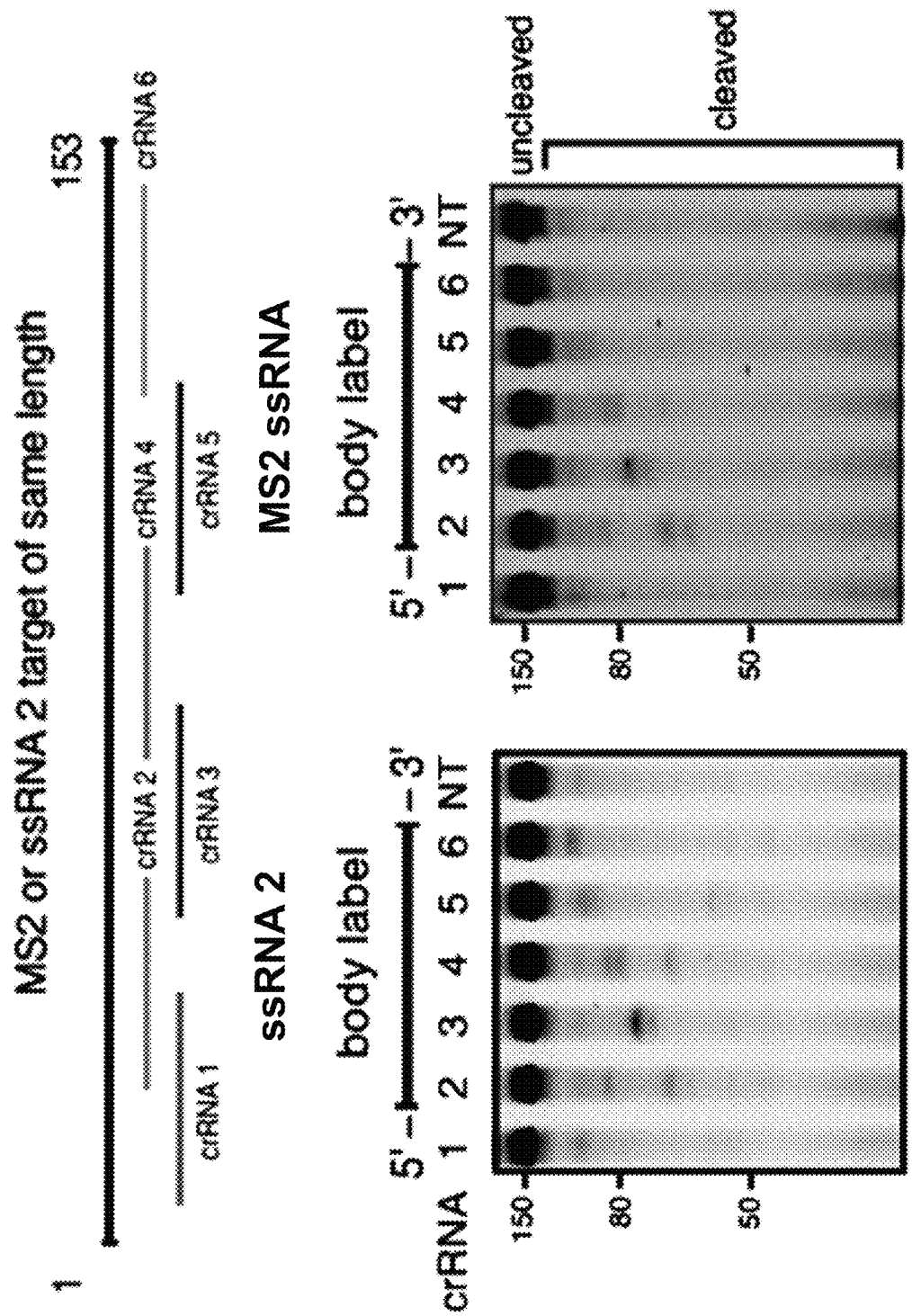
FIG. 18A illustrates DisCas7-11 incubated with a panel of crRNAs targeting either MS2 ssRNA or ssRNA target 2, two targets of equivalent length (153 nt) according to embodiments of the present teachings.
Figure 18B:
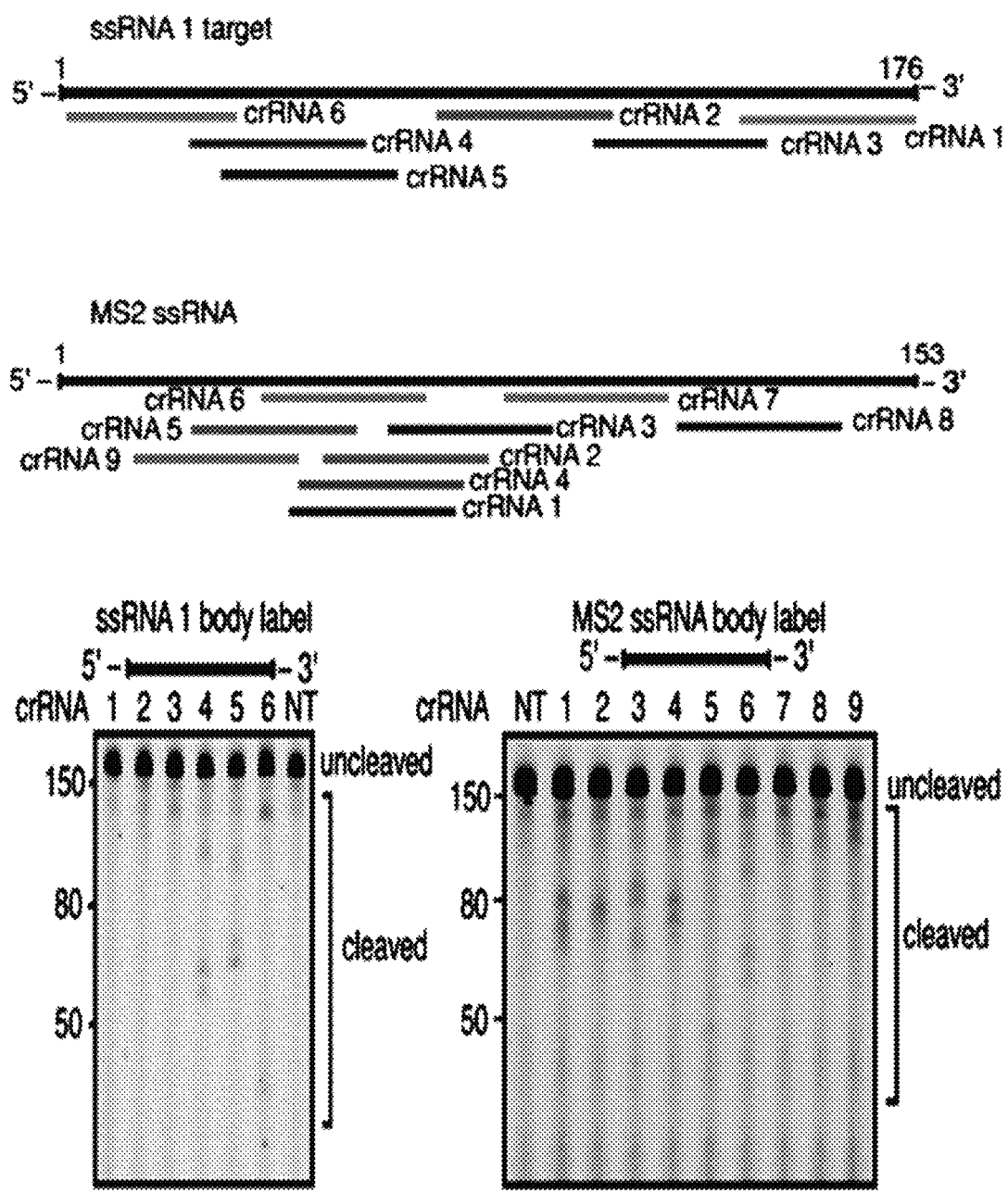
FIG. 18B illustrates the cleavage of ssRNA 1 and MS2 ssRNA at multiple sites with tiled crRNAs, showing a varying cleavage pattern based on target position according embodiments of the present disclosures.

DisCas7-11 was incubated with a panel of crRNAs targeting either MS2 ssRNA or ssRNA target 2, two targets of equivalent length (153 nt) (FIG. 18A). The crRNAs are designed to target sites at the same position on both targets in order to better understand whether sequence-specific cleavage preferences exist and whether cleavage cut sites are position dependent. The cleavage of ssRNA 1 and MS2 ssRNA at multiple sites with tiled crRNAs were also performed (FIG. 18B). A varying cleavage pattern based on target position was observed.

Figure 18C:
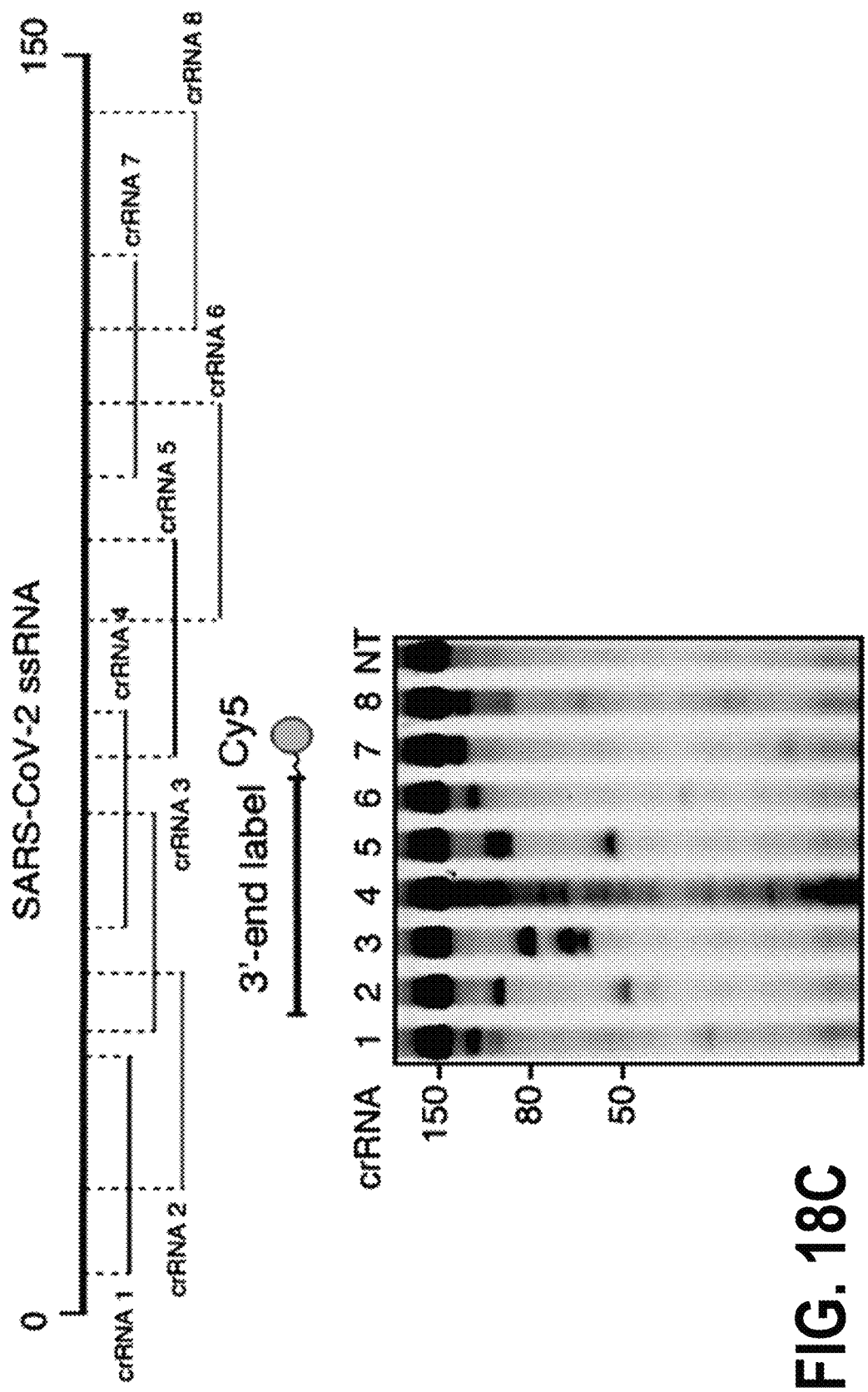
FIG. 18C shows the schematic of the position of the tested crRNAs along the SARS-CoV-2 ssRNA and the results from the cleavage of synthetic SARS-CoV-2 ssRNA at multiple sites with tiled crRNAs showing a varying cleavage pattern based on target position according to embodiments of the present teachings.
Figure 18D:
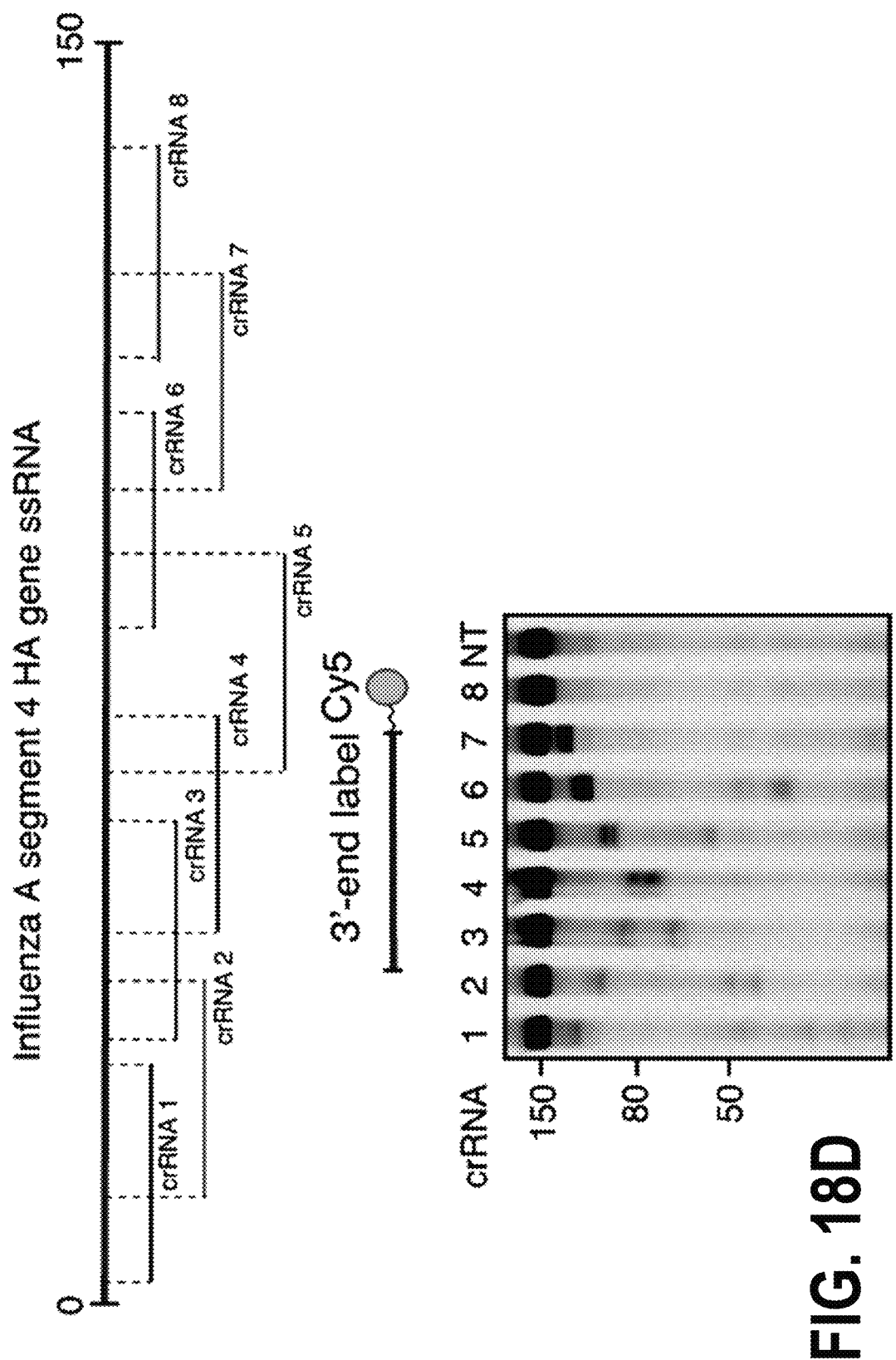
FIG. 18D shows the schematic of the position of the tested crRNAs along the Influenza A ssRNA target and the results from the cleavage of synthetic influenza A segment 4 HA gene ssRNA at multiple sites with tiled crRNAs according to embodiments of the present teachings.

A schematic of the position of the tested crRNAs along the SARS-CoV-2 ssRNA is shown in FIG. 18C. The results from the cleavage of synthetic SARS-CoV-2 ssRNA at multiple sites with tiled crRNAs showing a varying cleavage pattern based on target position are also shown in the same figure. A schematic of the position of the tested crRNAs along the Influenza A ssRNA target is shown in FIG. 18D. The results from the cleavage of synthetic influenza A segment 4 HA gene ssRNA at multiple sites with tiled crRNAs showing a varying cleavage pattern based on target position are also shown in the same figure.

DisCas7-11a was incubated with a crRNA targeting a crRNA site flanked by different sequences (FIG. 18E). While the spacer:target complementarity region is fixed, the sequences around the site are completely variable, allowing determination of any sequence preferences for cleavage. DisCas7-11a was also incubated with a crRNA targeting a double-stranded (dsDNA) target with 5' labeling of the bottom strand (FIG. 18F) or top strand (FIG. 18G).

Example 18

Cleavage Activity on Various Length EGFP ssRNA Substrates

Biochemical characterization of DisCas7-11 programmable RNA cleavage activity on various length EGFP ssRNA substrates was performed. A schematic of the position of the tested crRNAs along the 100 nt EGFP ssRNA target is shown in FIG. 19A. The biochemical characterization of programmable DisCas7-11 RNA cleavage of 100 nt long and 3' fluorescently labeled EGFP ssRNA target with tiling crRNAs is also shown in this figure. A schematic of the position of the tested crRNAs along the 200 nt EGFP ssRNA target is shown in FIG. 19B. The biochemical characterization of the programmable DisCas7-11 RNA cleavage of 200 nt long and 3' fluorescently labeled EGFP ssRNA target with tiling crRNAs is also shown in this figure. A schematic of the position of the tested crRNAs along the 600 nt EGFP ssRNA target is shown in FIG. 19C. The biochemical characterization of the programmable DisCas7-11 RNA cleavage of 600 nt long and 3' fluorescently labeled EGFP ssRNA target with tiling crRNAs is also shown in this figure. The DNA sequencing analysis of selected EGFP targeting crRNA conditions on an unlabeled 400 nt EGFP ssRNA target was performed (FIG. 19D). The DisCas7-11a cleavage was found to occur at both sides directly flanking the crRNA binding site, with cleavage occurring approximately 20 bases downstream of the 5' position of the spacer. Other biochemical characterizations of DisCas7-11 programmable RNA cleavage activity are shown in FIGS. 19E-19G

Example 19

Candidatus *Jettenia caeni* Type III-E CRISPR-Cas System

The heterologous expression of the Candidatus *Jettenia caeni* Type III-E CRISPR-Cas system and associated CRISPR array in *E. coli* was performed. The schematic of Candidatus *Jettenia caeni* locus (minus Cm') in *E. coli* is shown in FIG. 20. The processing of crRNAs occurs when the CjcCas7-11 locus is heterologously expressed in *E. coli*, and mature 37 nt crRNAs are generated containing a 15-nt DR.

Example 20

Processing of Cas7-11 Orthologs

The processing of Cas7-11 orthologs was found to be specific to the cognate pre-cRNAs and to do not occur on other synthetic RNAs. The DisCas7-11 pre-cRNA processing is specific to the DisCas7-11 array and does not occur on the MS2 ssRNA target as illustrated in FIG. 21A. The GwCas7-11 pre-cRNA processing is specific to the GwCas7-11 array and does not occur on the MS2 ssRNA target as illustrated in FIG. 21B. The CjcCas7-11 pre-cRNA processing is specific to the CjcCas7-11 array and does not occur on the MS2 ssRNA target as illustrated in FIG. 21C. FIG. 21D shows the comparison of target cleavage between active CjcCas7-11 and dead CjcCas7-11.

Example 21

Cas7-11 Correction of Cluc W85X

The correction of Cluc W85X mRNA by dDisCas7-11 was measured. A schematic of the DisCas7-11 guide design for RNA editing of Cluc W85A target mRNA is shown in FIG. 22A. A table disclosing the different guides used for the correction of the mRNA is shown in FIG. 22B. The dDisCas7-11 correction of Cluc W85X RNA by the different guides is shown in FIG. 22C, and the percentage editing for the correction is shown in FIG. 22D. The luciferase correction that correlates to the correction percent is shown in FIG. 22E.

Example 22

Harvesting and Next-Generation Sequencing of crRNA and Pre-crRNA from *Desulfonema ishimotonii* and *E. coli*

To extract total RNA, freeze-dried *Desulfonema ishimotonii* cultures (DSMZ 9680) were resuspended in TRIzol (R2051, Zymo), homogenized by bead beating with zirconia/silica beads, and processed with the Direct-Zol RNA miniprep protocol (R2051, Zymo). Purified RNA samples were treated with T4 Polynucleotide Kinase (M0201S, New England Biolabs), both with and without ATP to allow for the enrichment of 3'-P and 5'-OH ends. Samples has ribosomal RNA depleted using the Ribo Minus Kit (K155004, Thermo Fisher Scientific) before being processed for next-generation sequencing with the NEBNext Small RNA Library Prep Set for Illumina sequencing (E7330S, New England Biolabs). Notably, the PCR extension step was increased to 1 minute to allow for longer templates to be included in the library. Libraries were sequenced on an MiSeq (Illumina) to sufficient depth and analyzed using the alignment tool BWA (Li and Durbin 2009). Paired-end alignments were used to extract entire transcript sequences using Galaxy tools (https://usegalaxy.org/), and these sequences were analyzed using Geneious 8.1.5 (Biomatters, Auckland, New Zealand) and custom scripts (https://github.com/abugoot-lab).

Example 23

Design and Cloning of Bacterial Constructs

To clone DisCas7-11 constructs, genomic DNA from *D. ishimotonii* cultures (DSMZ 9680) was extracted using the Blood & Cell Culture DNA Mini Kit (13323, Qiagen). The Type III-E *D. ishimotonii* CRISPR locus was PCR amplified and cloned into a pACYC184 backbone with chloramphenicol resistance using Gibson cloning. For the Cas7-11 only construct, DisCas7-11a was cloned with a J23119 promoter and B0015 terminator. Removal or addition of other genes in the CRISPR locus was cloned using Gibson cloning; when adding genes to the Cas7-11-only construct, expression of these genes was driven by a pLac promoter. In order to facilitate simple cloning of spacers, a minimal spacer construct with two flanking direct repeats (DR) surrounding a Golden Gate acceptor site was used as a backbone for Golden Gate cloning (Engler and Marillonnet 2014). To clone the CjcCas7-11b locus, DNA corresponding to the locus was synthesized by GeneArt (Thermo Scientific). Unless otherwise noted, all clonings were transformed into Stb13 cells (C737303, Thermo Fisher Scientific) made competent with the Mix and Go kit (T3001, Zymo Research), all colonies were picked into Terrific Broth (TB) (24 g/L Yeast Extract, 12 g/L Tryptone, 9.4 g/L K2HPO4, 2.2 g/L KH2PO4, pH 7.2) supplemented with the appropriate antibiotic (chloramphenicol, 25 μg/mL; ampicillin, 100 μg/mL) and all plasmids were isolated using the QiaPrep Spin Miniprep kit (27104, Qiagen) protocol and verified by next generation sequencing on a MiSeq (Illumina). All bacterial plasmids used are listed in Table 3.

Example 24

Cloning of Screening Libraries for MS2 Interference Activity Screen

To design the MS2 library for screening, all possible spacers targeting the MS2 genome were computationally extracted, and synthesized as a library by Twist Biosciences. This library was Golden Gate cloned into the minimal CRISPR array containing the Golden Gate acceptor site on the DisCas7-11a-only backbone and transformed into Endura Duo electro-competent cells (60240-1, Lucigen) and plated on chloramphenicol-supplemented Bioassay agar plates. 16 hours post transformation, libraries were harvested by scraping and purified using a NucleoBond Xtra MaxiPrep EF (740424.10, Takara Bio).

Example 25

Bacterial Phage Interference PFS Screen Assay

To transform the MS2 spacer library, 400 uL NovaBlue (DE3) Gigasingle competent cells (71227-3, EMD Millipore) were transformed with a total of 2 ug of the spacer library. Cells were recovered in SOC while shaking at 37° C. for 1 hour. After recovery, cells were split into two biological replicates and used to inoculate 8 mL of Luria Broth (LB) (10 g/L tryptone, 5 g/L yeast extract, 5 g/L NaCl) supplemented with chloramphenicol. Cells were further incubated in LB-chlor while shaking at 37° C. for 4 hours, after which the volume was brought to a total of 12 mL for each biological replicate. Replicates were split into 6 2 mL tubes, and phages of different dilutions were added to each tube. Cells were incubated with phage while shaking at 37° C. for 3 hours, after which they were plated on Bioassay plates with LB-agar supplemented chloramphenicol. After 16 hours of growth, all colonies were harvested by scraping and scraped and plasmid DNA was extracted with the NucleoBond Xtra MaxiPrep EF (740424.10, Takara Bio). Spacer sequences were PCR amplified from extracted plasmids and sequenced using a MiSeq (Illumina) with a paired-end 150 cycle kit.

Example 26

Cloning of Libraries and Screening for Beta-lactamase and Transcribed/non-transcribed PFS Screens Plasmid libraries for PFS screens were cloned from synthesized oligonucleotides (IDT) consisting of 7 randomized nucleotides either upstream or downstream of the spacer 1 target. To generate dsDNA fragments for cloning, the ssDNA oligonucleotides were annealed to a short primer for second strand synthesis by large Klenow fragment (M0210S, New England Biolabs). dsDNA fragments were Gibson cloned into digested pUC19, either at the 5'-end of the beta-lactamase (Ampicillin resistance) transcript (RNA targeting library), or in a non-transcribed region of pUC19 (DNA targeting library). Gibson clonings were electroporated into Endura Duo electro-competent cells (60240-1, Lucigen) and plated on Bioassay plates with LB-agar supplemented with ampicillin. After 16 hours of growth, all colonies were harvested by scraping and scraped and plasmid DNA was extracted with the NucleoBond Xtra MaxiPrep EF (740424.10, Takara Bio).

To screen libraries, we co-transformed 50 ng of the pooled ampicillin library and an equimolar amount of the Cas7-11 locus plasmid or pACYC184 plasmid control intoNovaBlue (DE3) Gigasingle competent cells (71227-3, EMD Millipore). After transformation, cells were plated on ampicillin and chloramphenicol to select for both plasmids. After 16 hours of growth, all colonies were harvested by scraping and scraped and plasmid DNA was extracted with the NucleoBond Xtra MaxiPrep EF (740424.10, Takara Bio). The target PFS region was PCR amplified and sequenced using a MiSeq (Illumina) with a single-end 150 cycle kit.

Example 27

Computational Analysis of In Vivo Screens

To determine enriched spacers from the bacteriophage interference screens, sequenced spacer regions were counted and normalized to total reads for each sample. For enriched spacers, enrichment was measured as the log 2 ratio compared to no phage dilution controls, with a pseudocount adjustment. PFS regions (both at 5' and 3) from spacers above a 1.7 log 2 enrichment threshold in both biological replicates were used to generate sequence logos for the phage dilution samples.

For transcribed/non-transcribed (beta-lactamase) pUC19 PFS screens, PFS regions were extracted and computationally collapsed to 5 nt to have broader coverage. Collapsed PFS were counted and normalized to total reads for each sample. For a given PFS region, enrichment was measured as the log ratio compared to control (pACYC184 control), with a 0.01 pseudocount adjustment. PFSs above a 6 depletion threshold that were enriched in both biological replicates were collected and used to generate sequence logos (Crooks et al. 2004).

Example 28

Bacterial Phage Interference Assay for Individual Spacers

To test individual spacers for MS2 interference with drop plaque assays, complementary oligonucleotides encoding the spacer sequences (see Table 4) flanked by overhangs corresponding to the Cas7-11a Golden Gate acceptor sites were ordered from IDT. Oligonucleotides (final concentration 10M) were annealed in T4 ligase buffer (B0202S, New England Biolabs) supplemented with 5 units of T4 Polynucleotide Kinase (M0201S, New England Biolabs). The oligonucleotides were phosphorylated at 37° C. for 30 minutes and annealed by heating to 95° C. for 5 minutes followed by a 5° C./minute cool to 25° C. Annealed oligos were then cloned into the locus backbone by Golden Gate cloning. After verification by sequencing, clonal plasmids were transformed into NovaBlue(DE3) GigaSingle competent cells (71227-3, EMD Millipore) made competent with the Mix and Go kit (T3001, Zymo Research). Transformed GigaSingle cells were seeded from an overnight culture grown to OD600 of ~2, at which point they were diluted 1:6 in Top Agar (10 g/L tryptone, 5 g/L yeast extract, 10 g/L NaCl, 7 g/L agar) and poured onto warm LB-chloramphenicol plates. Dilutions of MS2 phage in phosphate buffered saline were then spotted on the plates with a multichannel pipette, and plaque formation was recorded after overnight incubation.

Example 29

RFP Targeting and Growth Assay

Spacers (see Table 4) targeting RFP mRNA were Golden Gate cloned into the DisCas7-11a-only construct (as described above). After verification by sequencing, clonal plasmids were co-transformed with a tetracycline-inducible RFP plasmid on the pBR322 backbone (Addgene 79157). Colonies were picked into TB supplemented with ampicillin, chloramphenicol, and 50 ng/mL anhydrotetracycline final (631310, Takara Bio) and grown to saturation by shaking at 37° C. overnight. Cells were separated by centrifugation through a 40 µm filter plate (MANMN4010, EMD Millipore) and analyzed by flow cytometry on a FACSCanto II Cell Analyzer (BD Biosciences). Knockdown efficiency was quantified as the percent of RFP positive cells compared to a non-targeting spacer control.

Example 30

Cas7-11 Protein Purification

The *E. coli* codon-optimized genes for DisCas7-11a and GwCas7-11c, and the human codon-optimized gene for CjcCas7-11b were synthesized by Twist Biosciences, PCR amplified, and Gibson into a Twin-Strep-tag and SUMO tag bacterial expression vector (Addgene 90097). Sequence verified clonal Cas7-11 expression constructs were transformed into either T7 Express lysY Competent *E. coli* cells (C3010I, New England Biolabs), for DisCas7-11a and GwCas7-11c, or Rosetta(DE3)pLysS Competent Cells (70956-3, EMD Millipore), for CjcCas7-11b. Colonies were picked and grown overnight in TB supplemented with ampicillin. 10 ml of overnight culture was used to inoculate 1 L of TB supplemented with ampicillin, and the culture was grown by shaking at 37° C. until the OD600 reached 1. At this point, cultures were cooled at 4° C. for 30 minutes, and induced with IPTG (16758, Sigma) to a final concentration of 500 NM. Induced cultures were grown overnight (16-24 hours) by shaking at 18° C. After growth, Cells were harvested by centrifuged at 17,700×g for 15 min at 4° C., and the cell pellet was frozen at −80° C. for later purification.

Frozen cell paste was crushed and resuspended to a final concentration of 250 mg/mL in lysis Buffer (20 mM Tris-HCl, 500 mM NaCl, 1 mM DTT, pH 8.0) supplemented with Complete Ultra EDTA-free protease inhibitor tablets (5892953001, Sigma), 1 mg/mL lysozyme (L6876, Sigma) and 1 U/mL Benzonase nuclease (E1014, Sigma). Resuspension was performed by spinning for 30 minutes at 4° C. After resuspension, the solution was sonicated on ice with a 600 W Ultrasonic Homogenizer (U.S. Solid) for 15 minutes with a 50% duty cycle. Sonicated lysate was cleared by centrifugation at 38,400×g for 1 hour at 4° C. The supernatant was supplemented with 1 mL of Strep-Tactin XT superflow high capacity resin (2-4030-010, IBA Life Sciences) and incubated with rotation for 1 hour at 4° C. Bound resin was loaded onto a glass Econo-Column (7371507, Bio-Rad) and washed with three column volumes of lysis buffer supplemented with Complete Ultra EDTA-free protease inhibitor tablets. To cleave protein off of bead-bound Twin-Strep-tag and SUMO tag, the resin was resuspended in 3 mL of SUMO digest buffer (30 mM Tris-HCl, 500 mM NaCl, 1 mM DTT, 0.15% NP-40, pH 8.0) supplemented with 100 ug of SUMO protease (purified in-house). Cleavage occurred on-column overnight at 4° C. with rotation, after which supernatant was drained from the column by gravity filtration and concentrated to a volume of 1 mL with a 100 kDa centrifugal filter (UFC810024, Sigma). Concentrated protein was loaded onto a gel filtration column (Superdex 200 Increase 10/300 GL, GE Healthcare Life Sciences) via an ÄKTA pure FPLC machine. The resulting fractions from gel filtration were analyzed by SDS-PAGE Stain-Free gels (4568096, Bio-Rad), and fractions containing protein were pooled, buffer exchanged into Storage Buffer (600 mM NaCl, 50 mM Tris-HCl pH 7.5, 5% glycerol, 2 mM DTT), quantified via comparison SDS-

Example 31

Nucleic Acid Target and Cas7-11 Pre-crRNA Preparation

RNA targets for testing cleavage and pre-crRNA targets were synthesized by in vitro transcription. Single stranded DNA oligonucleotide templates with a T7 RNA polymerase promoter appended at the 5' end were synthesized by IDT, and converted to dsDNA by PCR and gel extraction. Gel extracted dsDNA products (~1 µg/reaction) were used as input for the HiScribe T7 Quick High Yield RNA Synthesis kit (E2050S, New England Biolabs), with the 30 uL reaction size recommended for transcripts <300 nt. Transcription occurred overnight at 30° C., after which targets were purified with RNA Clean and Concentrator columns (R1017, Zymo Research). Labeling was performed with the 3' End-Tag End Labeling System (MB-9002, Vector Laboratories) and 5' EndTag End Labeling System (MB-9001, Vector Laboratories), per the manufacturer's instructions, which was followed by incubation with 100× molar ratio of Cyanine5.5 maleimide (17080, Lumiprobe) at 65° C. for 30 minutes. We confirmed that this labeling was not 5' or 3' specific, but rather body labeling, via Rnase H gel assays (FIG. S21), likely due to the intercalating or groove-binding properties of Cyanine5.5 (Biver et al. 2005). After labeling, RNA was purified with RNA Clean and Concentrator columns (R1017, Zymo Research). All targets used for in vitro cleavage are listed in supplemental Table 5.

Example 32

Cas7-11 crRNA Preparation crRNA designs were ordered from IDT as reverse complement DNA oligonucleotide templates with a T7 RNA polymerase promoter appended at the 5' end. These templates were annealed with a T7 promoter oligonucleotide, generating a dsDNA promoter region. Annealing occurred in Taq Buffer (B9014S, New England Biolabs) with both oligonucleotides at 10 µM. 1 uL of the anneal reaction was used as input for the HiScribe T7 Quick High Yield RNA Synthesis kit (E2050S, New England Biolabs), with the 30 uL reaction size recommended for transcripts <300 nt. Transcription occurred overnight at 37° C., after which targets were purified with RNAClean XP beads (A63987, Beckman Coulter); beads were used at 3.3× volume ratio and supplemented with 3× volume of isopropanol. All crRNA used for in vitro cleavage are listed in supplemental Table 6.

Example 33

In Vitro Nuclease Assays

Unless otherwise indicated, in vitro nuclease assays were performed with 233 nM purified Cas7-11, 30 nM of labeled ssRNA target and 200 nM crRNA in nuclease assay buffer (40 mM Tris-HCl, 60 mM NaCl, 6 mM MgCl2, pH 7.5) supplemented with 4 U of RNase Inhibitor, Murine (M0314S, New England Biolabs). For pre-crRNA processing reactions, crRNA was omitted and pre-crRNA was used in place of labeled ssRNA target. Reactions were incubated for 1 hour at 37° C. (unless otherwise indicated) and then quenched with addition of proteinase K, EDTA, and urea (final concentrations 1 mg/mL proteinase K, 6 mM EDTA, and 400 uM Urea) for 15 minutes at 50° C. To prepare for gel electrophoresis, reactions were denatured with 4.5M urea denaturing buffer at 95° C. for 5 minutes and loaded onto a 10% Novex PAGE TBE-Urea gel (EC6885BOX, Invitrogen), which was run at 235V for 25 minutes at 60° C. Gels were imaged using an Odyssey scanner (LI-COR Biosciences).

Example 34

Experimental and Computational Analysis of In Vitro PFS Screens

In vitro PFS screens were reverse transcribed with a target specific primer using the qScript cDNA SuperMix (95048-025, Quanta Bio) and, the target PFS region was PCR amplified and sequenced using a MiSeq (Illumina) with a single-end 150 cycle kit. PFS regions were computationally extracted and collapsed to 5 nt to have broader coverage, and collapsed PFS were counted and normalized to total reads for each sample. For a given PFS region, enrichment was measured as the log ratio compared to non-targeting control, with a 0.01 pseudocount adjustment. PFSs above a 5 depletion threshold that were enriched in both experimental replicates were collected and used to generate sequence logos

Example 35

In Vitro Collateral Activity Assays

In vitro collateral activity assays were performed with 233 nM purified Cas7-11 or LwaCas13a, 10 nM of unlabeled ssRNA target and 200 nM crRNA in nuclease assay buffer (40 mM Tris-HCl, 60 mM NaCl, 6 mM MgCl2, pH 7.5) supplemented with 4 U of RNase Inhibitor, Murine (M0314S, New England Biolabs) and 250 nM final concentration RnaseAlert V2 (4479768, Thermo Fisher Scientific). Reactions were incubated at 37° C. and activity was read continuously in the FAM channel of a Synergy Neo2 plate reader (BioTek).

Example 36

Electrophoretic Mobility Shift Assay (EMSA)

EMSA reactions were performed with dilutions of Cas7-11-crRNA complex with 10 nM of labeled ssRNA target in EMSA buffer (5 mM EDTA, 2.5% glycerol, 20 mM Tris, 5 µg/mL heparin, pH 7.5) supplemented with 4 U of RNase Inhibitor, Murine (M0314S, New England Biolabs). Binding occurred by incubation at 37° C. for 20 minutes, after which reactions were mixed with 2× loading buffer (0.5×TBE buffer, 10% Ficoll, 18 mM EDTA) and run on a 6% Novex PAGE TBE gel (EC6265BOX, Thermo Fisher Scientific) at 180V for 30 min at 4° C. Gels were imaged using an Odyssey scanner (LI-COR Biosciences).

Example 37

Next-Generation Sequencing of In Vitro Cleaved RNA

In vitro nuclease assays were performed and samples were quenched as described above using unlabeled ssRNA targets. After quenching, samples were treated with alkaline phosphatase (EF0651, Thermo Fisher Scientific) and purified with RNA Clean and Concentrator columns (R1017, Zymo Research). Libraries were then treated with the same small RNA sequencing pipeline applied to in vivo crRNA species, with the RiboMinus depletion step omitted.

Example 38

Design and Cloning of Mammalian Constructs

To generate vectors for testing DisCas7-11a in mammalian cells, a mammalian codon optimized DisCas7-11a sequence was ordered from Twist Biosciences, PCR amplified, and cloned into a mammalian expression vector containing combinations of modifications, including with and without NLS tags or N- or C-terminal msfGFP fusions, all under the control of a CMV promoter.

The dual luciferase reporter was cloned by PCR amplifying *Gaussia* and *Cypridinia* luciferase coding DNA, the EF1alpha and CMV promoters and assembled using the NEB Gibson Assembly (E2611S, New England Biolabs).

For mammalian DisCas7-11a guide expression, we synthesized both the full-length and mature DR sequences and cloned with golden-gate acceptor sites under U6 expression via restriction digest cloning. Individual guides were then cloned into the corresponding expression backbones for DisCas7-11a by golden-gate cloning. All mammalian DisCas7-11 plasmids are listed in Table 7. All DisCas7-11a guide sequences for knockdown or RNA editing experiments are listed in Table 8.

Example 39

Mammalian Cell Culture

All mammalian experiments were performed using the HEK293FT cell line (American Type Culture Collection (ATCC)). HEK293FT cells were grown in Dulbecco's Modified Eagle Medium with high glucose, sodium pyruvate, and GlutaMAX (Thermo Fisher Scientific), additionally supplemented with 1×penicillin-streptomycin (Thermo Fisher Scientific) and 10% fetal bovine serum (VWR Seradigm). We maintained cells below a confluency of 80%.

Transfections were performed using Lipofectamine 2000 (Thermo Fisher Scientific) in 96-well plates coated with poly-D-lysine (BD Biocoat). For transfections, cells were plated 16 hours prior to transfection at seeding densities of ~20,000-30,000 cells per well, allowing cells to reach 90% confluency by transfection. For each well on the plate, transfection plasmids were combined with Opti-MEM I Reduced Serum Medium (Thermo Fisher) to a total of 25 µl. Separately, 24.5 µl of Opti-MEM was combined with 0.5 µl of Lipofectamine 2000. Plasmid and Lipofectamine solutions were then combined and incubated for 5-10 minutes, after which they were pipetted onto cells.

Example 40

Mammalian Cell RNA Knockdown Assays

To assess RNA knockdown in mammalian cells with reporter constructs, 100 ng of DisCas7-11a expression vector was co-transfected with 150 ng of guide expression plasmid and 40 ng of the knockdown reporter construct. After 48 hours, we harvested media containing secreted luciferase and measured luciferase activity using the *Gaussia* Luciferase Assay reagent (GAR-2B) (Targeting Systems) and *Cypridina* (*Vargula*) luciferase assay reagent (VLAR-2) (Targeting Systems) kits. Assays were performed in white 96 well plates on a plate reader (Biotek Synergy Neo 2) with an injection protocol. All replicates performed are biological replicates. Luciferase measurements were normalized by dividing the Gluc values by the Cluc values, thus normalizing for variation from well to well.

For targeting of endogenous genes, 100 ng of DisCas7-11a expression vector was co-transfected with 150 ng of guide expression plasmid. After 48 hours, we lysed cells and harvested RNA using a method previously described (Joung et al. 2017) with a gene-specific reverse transcription primers. Using Fast Advanced Master Mix (Thermo Fisher Scientific), we measured gene expression using the cDNA via qPCR and TaqMan qPCR probes for the KRAS, PPIB, CXCR4, and MALAT1 transcripts (Thermo Fisher Scientific) as well as the GAPDH control probe (Thermo Fisher Scientific). qPCR reactions were read out on a Bio-Rad CFX384 Touch Real-Time PCR Detection System, with four 5 µl technical replicates in 384-well format.

Example 41

RNA Editing in Mammalian Cells

To assess dDisCas7-11a-ADAR2dd editing activity in mammalian cells, we transfected 100 ng of dDisCas7-11a-ADAR2dd expression vector, 150 ng of guide expression plasmid, and 25 ng of the RNA editing reporter. After 48 hours, we harvested media from the cells, which should contain the secreted Gluc (normalization control) and Cluc (protein targeted for correction of W85X) proteins. If planning to sequence the RNA for the precise RNA editing levels, we also harvested RNA using a method previously described (Joung et al. 2017) with a gene-specific reverse transcription primer.

For luciferase measurements, we used undiluted media and the *Gaussia* Luciferase Assay reagent (GAR-2B) (Targeting Systems) and *Cypridina* (*Vargula*) luciferase assay reagent (VLAR-2) (Targeting Systems) kits. Assays were performed in white 96 well plates on a plate reader (Biotek Synergy Neo 2) with an injection protocol. All replicates performed are biological replicates. Luciferase measurements were normalized by dividing the Cluc values by the Gluc values, thus normalizing for variation from well to well. This ratio measurement could further be normalized by dividing by the non-targeting guide ratios.

For sequencing of RNA editing rates, we performed two rounds of PCR (NEBNext High-Fidelity 2×PCR Master Mix from New England Biolabs) using the extracted cDNA to add Illumina adaptors and sample barcodes. Illumina next generating sequencing was used to sequence editing rates in our prepared libraries on a MiSeq instrument. RNA editing rates were evaluated at the targeted adenosine in the W85X pre-termination codon.

Example 42

DisCas7-11-Mediated RNA-Guided RNA Interference Against MS2 Phage and RNA Knockdown in *E. coli*

DisCas7-11-mediated RNA-guided RNA interference against MS2 phage and RNA knockdown in *E. coli* was investigated. The potential role of PFS in the function of the III-E systems was assessed by performing randomized PFS screens on both a DNA-only target and an expressed target at the 5' end of an ampicillin gene. It was found that there was no signal on the DNA-only target on either side of the protospacer (FIG. 28A) and only a weak sequence preference when cleaving the expressed target (FIG. 28B). Furthermore, it was found that there were no observable trends in the flanking sequences of enriched MS2 spacers (FIGS. 28C and 28D), suggesting a lack of targeting constraints.

Example 43

Regulation of DisCas7-11 Interference Activity by Accessory Proteins

The regulation of DisCas7-11 interference activity by accessory proteins was assessed. Whether accessory proteins in the *D. ishimotonii* subtype III-E CRISPR locus could modulate RNA interference activity was investigated (FIG. 28E). Expression of the full *D. ishimotonii* CRISPR locus resulted in reduced MS2 interference compared to DisCas7-11 alone (FIG. 28F), prompting us to test the deletion of each putative accessory gene. Deletion of Csx29 was found to restore the interference activity. (FIG. 28G).

Example 44

Mapping DisCas7-11a Cleavage Mechanism

The mapping of the DisCas7-11a cleavage mechanism via in vitro cleavage of ssRNA of a 31 nt target was investigated. The DisCas7-11a cleavage of synthetic 31 nt MS2 ssRNA with a 31 nt crRNA completely duplexed to the target shows two cleavage fragments that are generated in the targeting condition when protein is generated (indicated by triangles) (FIG. 29). Other bands present in all conditions indicate incomplete products generated when in vitro transcribing the 31 nt target.

Example 45

DisCas7-11a-Mediated Knockdown of mRNA in Mammalian Cells

The effects of DisCas7-11a-mediated knockdown of mRNA in mammalian cells by guide variants or inactivating mutations was measured. The knockdown of *Gaussia* luciferase (Gluc) mRNA in mammalian cells by DisCas7-11a unmodified or with N-/C-terminal msfGFP fusions, with guides containing the full DR sequence was assessed. The guides are designed to be tiled across the Gluc transcript. The knockdown of Gluc mRNA in mammalian cells by DisCas7-11a unmodified or with N-/C-terminal msfGFP fusion, with guides containing the mature DR sequence was assessed. Guides are designed to be tiled across the Gluc transcript. The comparison of knockdown activity of Gluc mRNA in mammalian cells between active DisCas7-11a, catalytically inactive D429A/D654A DisCas7-11a, and GFP is illustrated in FIG. 31A. Guides are the same as in a and b above and have the full DR sequence. The comparison of knockdown activity of endogenous mRNA in mammalian cells between active DisCas7-11a, catalytically inactive D429A/D654A DisCas7-11a, and GFP is illustrated in FIG. 31B. Here the guides have the full DR sequence.

Example 46

RNA Editing Efficiency with DisCas7-11a-NES-ADAR2 Constructs

The RNA editing efficiency with active and inactive DisCas7-11a-NES-ADAR2 constructs was measured. The RNA A-to-I editing of *Cypridinia* luciferase (cluc) mRNA W85X mutation in mammalian cells by active DisCas7-11a-NES-ADAR2 or dead DisCas7-11a-NES-ADAR2 is shown in FIG. 32A. The guides are designed with mismatch distances between 2-50 nt. Editing is measured by restoration of Cluc luciferase activity and is normalized to the non-targeting guide condition. The RNA A-to-I editing of *Cypridinia* luciferase (cluc) mRNA W85X mutation in mammalian cells by active DisCas7-11a-NES-ADAR2 or dead DisCas7-11a-NES-ADAR2 is shown in FIG. 32B. The guides are designed with mismatch distances between 2-50 nt, and the editing is measured by amplicon sequencing and measuring the percent correction of the pre-termination stop codon.

Example 47

RNase H Cleavage of Target Showing Body Labeling

The RNase H cleavage of target showing body labeling was investigated. Cleavage of 3' (FIG. 33A) and 5' (FIG. 33B) labeled targeted by incubation with RNase H and indicated oligonucleotides show similar band patterns and double bands indicative of body labeling.

Example 48

Mechanism of the Programmable RNA Cleavage Activity of DisCas7-11

The mechanism of the programmable RNA cleavage activity of DisCas7-11 was assessed. The type III-E system from *D. ishimotonii* and corresponding effector DisCas7-11 were chosen, as a representative of type III-E systems to characterize in detail. The small RNA from *D. ishimotonii* were harvested and sequenced. Mature crRNA species indicative of pre-crRNA processing were identified (FIG. 2C), a hallmark of an active CRISPR-Cas locus. Heterologous reconstitution of the *D. ishimotonii* type III-E locus in *E. coli* demonstrated similar processing (FIG. 9A), and expression of the DisCas7-11 protein and pre-crRNA were both necessary and sufficient for mature crRNA expression (FIG. 9B and FIG. 9C), suggesting that Cas7-11 possesses pre-crRNA processing activity. Processing occurred though cleavage in the second hairpin of the direct repeat (DR) at residue 21, generating a mature rRNA with spacers of ~18-24 nt and 14 nt DRs lacking any predicted secondary structure, similar to the mature DR tags of other type III systems (FIG. 2D). To generalize the observation of the processing activity of Cas7-11 beyond *D. ishimotonii*, the Candidatus *Jettenia caeni* type III-E locus through heterologous expression in *E. coli* was assessed. Robust processing of the C. *Jettenia caeni* pre-crRNA that resulted in mature crRNAs 37 nt in length was observed (FIG. 20), suggesting that pre-crRNA processing activity is common among type III-E systems.

One skilled in the art will appreciate further features and advantages of the invention based on the above-described embodiments. Accordingly, the invention is not to be limited by what has been particularly shown and described, except as indicated by the appended claims. All publications and references cited herein are expressly incorporated herein by reference in their entirety.

SEQUENCE LISTING (647 sequences)

SEQ ID NO: 1 - protein, 1812 aa, Unknown
  source: /note="Description of Unknown: Candidatus Jettenia caeni sequence"
MHTILPIHLTFLEPYRLAEWHAKADRKKNKRYLRGMSFAQWHKDKDGIGKPYITGTLLRSAVLNAAEELISLNQGMWAKEPCCNGKFETEKDKPAVLRKRPTIQWKTGRPAICDPEKQEKKDACPLCMLLGRFDKAGKRHRDNKYDKHDYDIHFDNLNLITDKKFSHPDDIASERILNRVDYTTGKAHDYFKVWEVDDDQWWQFTGTITMHDDCSKAKGLLLASLCFVDKLCGALCRIEVTGNNSQDENKEYAHPDTGIITSLNLKYQNNSTIHQDAVPLSGSAHDNDEPPVHDNDSSLDNDTITLLSMKAKEIVGAFRESGKIEKARTLADVIRAMRLQKPDIWEKLPKGINDKHHLWDREVNGKKLRNILEELWRLMNKRNAWRTFCEVLGNELYRCYKEKTGGIVLRFRTLGETEYYPEPEKTEPCLISDNSIPITPLGGVKEWIIIGRLKAETPFYFGVQSSFDSTQDDLDLVPDIVNTDEKLEANEQTSFRILMDKKGRYRIPRSLIRGVLRRDLRTAFGGSGCIVELGRMIPCDCKVCAIMRKITVMDSRSENIELPDIRYRIRLNPYTATVDEGALFDMEIGPEGITFPFVFRYRGEDALPRELWSVIRYWMDGMAWLGGSGSTGKGRFALIDIKVFEWDLCNEEGLKAYICSRGLRGIEKEVLLENKTIAEITNLFKTEEVKFFESYSKHIKQLCHECIINQISFLWGLRSYYEYLGPLWTEVKYEIKIASPLLSSDTISALLNKDNIDCIAYEKRKWENGGIKFVPTIKGETIRGIVRMAVGKRSGDLGMDDHEDCSCTLCTIFGNEHEAGKLRFEDLEVVEEKLPSEQNSDSNKIPFGPVQDGDGNREKECVTAVKSYKKKLIDHVAIDRFHGGAEDKMKFNTLPLAGSFEKPIILKGRFWIKKDIVKDYKKKIEDAMVDIRDGLYPIGGKTGIGYGWVTDLTILNPQSGFQIPVKKDISPEPGTYSTYPSHSTPSLNKGHIYYPHYFLAPANTVHREQEMIGHEQFHKEQKGELLVSGKIVCTLKTVTPLIIPDTENEDAFGLQNTYSGHKNYQFFHINDEIMVPGSEIRGMISSVYEAITNSCFRVYDETKYITRRLSPEKKDESNDKNKSQDDASQKIRKGLVKKTDEGFSIIEVERYSMKTKGGTKLVDKVYRLPLYDSEAVIASIQFEQYGEKNEKRNAKIRAAIKRNEVIAEVARKNLIFLRSLTPEELKKVLQGEILVKFSLKSGKNPNDYLAELHENGTERGLIKFTGLNMVNIKNVNEEDKDFNDTWDWEKLNIFHNAHEKRNSLKQGYPRPVLKFIKDRVEYTIPKRCERIFCIPVKNTIEYKVSSKVCKQYKDVLSDYEKNFGHINKIFTTKIQKRELTDGDLVYFIPNEGADKTVQAIMPVPLSRITDSRTLGERLPHKNLLPCVHEVNEGLLSGILDSLDKKLLSIHPEGLCPTCRLFGTTYYKGRVRFGFANLMNKPKWLTERENGCGGYVTLPLLERPRLTWSVPSDKCDVPGRKFYIHHNGWQEVLRNNDITPKTENNRTVEPLAADNRFTFDVYFENLREWELGLLCYCLELEPGMGHKLGMGKPMGFGSVKIAIERLQTFTVHQDGINWKPSENEIGVYVQKGREKLVEWFTPSAPHKNMEWNGVKHIKDLRSLLSIPGDKPTVKYPTLNKDAEGAISDYTYERLSDTKLLPHDKRVEYLRTPWSPWNAFVKEAEYSPSEKSDEKGRETIRTKPKSLPSVKSIGKVKWFDEGKGFGILIMDDGKEVSISKNSIRGNILLKKGQKVTFHIVQGLIPKAEDIEIAK

SEQ ID NO: 2 - protein, 1717 aa, Unknown
  source: /note="Description of Unknown: Candidatus Scalindua brodae sequence"
MNITVELTFFEPYRLVEWFDWDARKKSHSAMRGQAFAQWTWKGKGRTAGKSFITGTLVRSAVIKAVEELLSLNNGKWEGVPCCNGSFQTDESKGKKPSFLRKRHTLQWQANNKNICDKEEACPFCILLGRFDNAGKVHERNKDYDIHFSNFDLDHKQEKNDLRLVDIASGRILNRVDFDTGKAKDYFRTWEADYETYGTYTGRITLRNEHAKKLLLASLGFVDKLCGALCRIEVIKKSESPLPSDTKEQSYTKDDTVEVLSEDHNDELRKQAEVIVEAFKQNDKLEKIRILADAIRTLRLHGEGVIEKDELPDGKEERDKGHHLWDIKVQGTALRTKLKELWQSNKDIGWRKFTEMLGSNLYLIYKKETGGVSTRFRILGDTEYYSKAHDSEGSDLFIPVTPPEGIETKEWIIVGRLKAATPFYFGVQQPSDSIPGKEKKSEDSLVINEHTSFNILLDKENRYRIPRSALRGALRRDLRTAFGSGCNVSLGGQILCNCKVCIEMRRITLKDSVSDFSEPPEIRYRIAKNPGTATVEDGSLFDIEVGPEGLTFPFVLRYRGHKFPEQLSSVIRYWEENDGKNGMAWLGGLDSTGKGRFALKDIKIFEWDLNQKINEYIKERGMRGKEKELLEMGESSLPDGLIPYKFFEERECLFPYKENLKPQWSEVQYTIEVGSPLLTADTISALTEPGNRDAIAYKKRVYNDGNNAIEPEPRFAVKSETHRGIFRTAVGRRTGDLGKEDHEDCTCDMCIIFGNEHESSKIRFEDLELINGNEFEKLEKHIDHVAIDRFTGGALDKAKFDTYPLAGSPKKPLKLKGRFWIKKGFSGDHKLLITTALSDIRDGLYPLGSKGGVGYGWVAGISIDDNVPDDFKEMINKTEMPLPEEVEESNNGPINNDYVHPGHQSPKQDHKNKNIYYPHYFLDSGSKVYREKDIITHEEFTEELLSGKINCKLETLTPLIIPDTSDENGLKLQGNKPGHKNYKFFNINGELMIPGSELRGMLRTHFEALTKSCFAIFGEDSTLSWRMNADEKDYKIDSNSIRKMESQRNPKYRIPDELQKELRNSGNGLFNRLYTSERRFWSDVSNKFENSIDYKREILRCAGRPKNYKGGIIRQRKDSLMAEELKVHRLPLYDNFDIPDSAYKANDHCRKSATCSTSRGCRERFTCGIKVRDKNRVFLNAANNNRQYLNNIKKSNHDLYLQYLKGEKKIRFNSKVITGSERSPIDVIAELNERGRQTGFIKLSGLNNSNKSQGNTGTTFNSGWDRFELNILLDDLETRPSKSDYPRPRLLFTKDQYEYNITKRCERVFEIDKGNKTGYPVDDQIKKNYEDILDSYDGIKDQEVAERFDTFTRGSKLKVGDLVYFHIDGDNKIDSLIPVRISRKCASKTLGGKLDKALHPCTGLSDGLCPGCHLFGTTDYKGRVKFGFAKYENGPEWLITRGNNPERSLTLGVLESPRPAFSIPDDESEIPGRKFYLHHNGWRIIRQKQLEIRETVQPERNVTTEVMDKGNVFSFDVRFENLREWELGLLLQSLDPGKNIAHKLGKGKPYGFGSVKIKIDSLHTFKINSNNDKIKRVPQSDIREYINKGYQKLIEWSGNNSIQKGNVLPQWHVIPHIDKLYKLLWVPFLNDSKLEPDVRYPVLNEESKGYIEGSDYTYKKLGDKDNLPYKTRVKGLTTPWSPWNPFQVIAEHEEQEVNVTGSRPSVTDKIERDGKMV

SEQ ID NO: 3 - protein, 1659 aa, Unknown
  source: /note="Description of Unknown: Desulfobacteraceae bacterium 4572_88 sequence"
MKITLRFLEPFRMLDWIRPEERISGNKAFQRGLTFARWHKSKADDKGKPFITGTLLRSAVIRAAEHLLVLSKGKVGEKACCPGKFLTETDTETNKAPTMFLRKRPTLKWTDRKGCDPDFPCPLCELLGPGAVGKKEGEAGINSYVNFGNLSFPGDTGYSNAREIAVRRVVNRVDYASGKAHDFFRIFEVDHIAFPCFHGEIAFGENVSSQARNLLQDSLRFTDRLCGALCVIRYDGDIPKCGKTAPLPETESIQNAAEETARAIVRVFHGGRKDPEQAQIDKAEQIQLLSAAVRELGRDKKKVSALPLNHEGKEDHYLWDKKAGGETIRTILKAAAEKEAVANQWRQFCIELSEELYKEAKKAHGGLEPARRIMGDAEFSDKSVPDTVSHSIGISVEKETIIMGTLKAETPFFFGIESKEKKQTDLMLLLDGQNHYRIPRSALRGILRRDIRSVLGTGCNAEVGGRPCLCPVCRIMKNITVMDTRSSTDTLPEVRPRIRLNPFTGSVQEKALFNMEMGTEGIEFPFVLSYRGKKTLPKELRNVLNWWTEGKAFLGGAASTGKSIFQLSDIHAFSSDLSDETARESYLSNHGWRGIMENSIVHESPLEGGAGGCSFGLSDLPKLGWHAEDLKLSDIEKYKPFHRQKISVKITLNSPFLNGDPVRALTEDVADIVSFKKYTQGGEKIIYAYKSESFRGVVRTALGLRNQGNDDITGKKNVPLIALTHQDCECMLCRFFGSEYEAGRLYFEDLTFESEPEPRRFDHVAIDRFTGGAVNQKKFDDRSLVPGKEGFMTLIGCFWMRKDKELSRNEIEELGKAFADIRDGLYPLGAKGSMGYGQVAELSIVDDEDSDDENNPAKLLAESMKNASPSLGTPTSLKKKDAGLSLRFDENADYYPYYFLEPEKSVHRDPVPPGHEEAFRGGLLTGRITCRLTVRTPLIVPNTETDDAFNMKEKAGKKKDAYHKSYRFFTLNRVPMIPGSEIRGMISSVFEALSNSCFRIFDEKYRLSWRMDADVKELEQFKPGRVADDGKRIEEMKEIRYPFYDRTYPERNAQNGYFRWDARISLTDNSMRKMEKDGVPRNVIYKLNTLKNKAYKSEKSFLFDLKNKAGGVGRYKKLVLKHAEVRGGEIPYYSHPTPTDCKLLSLVGPNRQLCRQDTLVQYRIIKHRRGAKPEEDFMFVGTPSENQKGHKENNDHGGGYLKISGPNKIEKENVLTSGVPSVPENMGAVVHNCPPRLVEVTVRCGRKQEEECKRKRLVPEYVCADPEKKVTYTMTKRCERIFLEKSRRIIPFTNDAVDKFEILVKEYRRNAEQQDTPEAFQTILPENGTVNPGDLLYFREEKGKAAEIVPVRISRKVDDRHIGKRIDPELRPCHGEWIEDGDLSKLDAYPAEKKLLTRHPKGLCPACRVFGTGSYKSRVRFGFAALKGTPKWLKEDPAEPSQGKGITLPLLERPRPTWAVLHNDKENSEIPGRKFYVHHNGWKGISEGIHPISGENIEPDENNRTVEVLDKGNRFVFELSFENLEPRELGLLIHSLQLEKGLAHKLGMAKSMGFGSVEIDVESVRVKHRSGEWDYKDGETVDGWIEEGKRGVAAKGKANDLRKLLYLPGEKQNPHVHYPTLKKEKKGDPPGYEDLKKSFREKKLNRRKMLTTLWEPWHK

SEQ ID NO: 4 - protein, 1657 aa, Unknown
  source: /note="Description of Unknown: Candidatus Magnetomorum sp. HK-1 sequence"
MLKLKVKITYFQPFRVIPWIKEDDRNSDRNYLRGGTFARWHKDKKDDIHGKPYITGTLLRSALFTEIEKIKIHHSDFIHCCNAIDRTEGKHQPSFLRKRPVYTENKNIQACNKCPLCLIMGRGDDRGEDLKKKKHYNGKHYQNWTVHFSNFDTQATFYWKDIVQKRILNRVDQTCGKAKDFFKVCEVDHIACPTLNGIIRINDEKLSQEEISKIKQLIAVGLAQIESLAGGICRIDITNQNHDDLIKSFFETKPSKILQPNLKESGEERFELAKLELLAEYLTQSFDANQKEQQLRRLADAIRDLRKYSPDYLKDLPKGKKGGRTSIWNKKVADDFTLRDCLKNQKIPNELWRQFCEGLGREVYKISKNISNRSDAKPRLLGETEYAGLPLRKEDEKEYSPTYQNQESLPKTKWIISGELQAITPFYIGHVNKTSHTRSTIFLNMNGQFCIPRSTLRGALRRDLRLVFGDSCNTPVGSRVCYCQVCQIMRCIKFEDALSDVDSPPEVRHRIRLNCHTGVVEEGALFDMETGFQGMIFPFRLYYESKNEIMSQHLYEVLNNWTNGQAFFGGEAGTGFGRFKLLNNEVFLWEIDGEEEDYLQYLFSRGYKGIETDEIKKVADPIKWKTLFTKLEIPPEKIPLTQLNYTLTIDSPLISRDPIAAMLDNRNPDAVMVKKTILVYEQDSSTHKNVPKEVPKYFIKSETIRGLLRSIISRTEIKLEDGKKERIFNLDHEDCDCLQCRLFGNVHQQGILRFEDAEITNKNVSDCCIDHVAIDRFTGGGVEKMKFNDYPLSASPKNCLNLKGSIWITSALKDSEKEALSKALSELKYGYASLGGLSAIGYGRVKELTLEENDIIQLTEITESNLNSQSRLSLKPDVKKELSNNHFYYPHYFIKPAPKEVVRESRLISHVQGHDTEGEFLLTGKIKCRLQTLGPLFIANNDKGDDYFELQHNNPGHLNYAFFRINDHIAIPGASIRGMISSVFETLTHSCFRVMDDKKYLTRRVIPESETTQKRKSGRYQVEESDPDLFPGRVQKKGNKYKIEKMDEIVRLPIYDNFSLVERIREYHYSEECASYVPSVKKAIDYNRMLAQAADSNREFLYNHPEAKSILQGKKEVYYILHKQESKNRGKTKEINPNARYACLTDENTPGSRKGFIKFTGPDMVTVNKELKSKIAPIYDPEWEKDIPDWERSNQESNHKYSFILHNEIEMRSSQKKKYPRPVFICKKNGVEYRMQKRCERIFDFTKEEEKDKEIVIPQKVVSQYNAILKDNKENTETIPGLFNSKMVNKELEDGDLVYFKYKEGKVTELTPVAISRKTDNKPMGKRFPKISINGKMKPNDSLRSCSHTCTEDCDDCPNLCESVKDYFKPHPDGLCPACHLFGTTFYKSRLSFGLAWLENNAKWYISNDFQQKDSKKEKGGKLTLPLLERPRPTWSMPNNNAEVPGRKFYVHHPWSVENIKNNQGNQKDISLKPDSDAIKIKENNRTIEPLGKDNVFNFEISFNNLRDWELGLLLYAIELEDHLAHKLGMAKAFGMGSVKIEIKNLLIKGSINDISKAELIKKGFKKLGIDSLEKDDLSEYLHIKQLREILWFSDKPVGTIEYPKLENKTNSRIPSYTDFVQEKDHETGFKNPKYQNLKSRLHILQNPWNAWWKNEE

SEQ ID NO: 5 - protein, 1601 aa, Desulfonema ishimotonii
MTTTMKISIEFLEPFRMTKWQESTRRNKNNKEFVRGQAFARWHRNKKDNTKGRPYITGTLLRSAVIRSAENLLTLSDGKISEKTCCPGKFDTEDKDRLLQLRQRSTLRWTDKNPCPDNAETYCPFCELLGRSGNDGKKAEKKDWRFRIHFGNLSLPGKPDFDGPKAIGSQRVLNRVDFKSGKAHDFFKAYEVDHTRFPRFEGEITIDNKVSAEARKLLCDSLKFTDRLCGALCVIRFDEYTPAADSGKQTENVQAEPNANLAEKTAEQIISILDDNKKTEYTRLLADAIRSLRRSSKLVAGLPKDHDGKDDHYLWDIGKKKKDENSVTIRQILTTSADTKELKNAGKWREFCEKLGEALYLKSKDMSGGLKITRRILGDAEFHGKPDRLEKSRSVSIGSVLKETVVCGELVAKTPFFFGAIDEDAKQTDLQVLLTPDNKYRLPRSAVRGILRRDLQTYFDSPCNAELGGRPCMCKTCRIMRGITVMDARSEYNAPPEIRHRTRINPFTGTVAEGALFNMEVAPEGIVFPFQLRYRGSEDGLPDALKTVLKWWAEGQAFMSGAASTGKGRFRMENAKYETLDLSDENQRNDYLKNWGWRDEKGLEELKKRLNSGLPEPGNYRDPKWHEINVSIEMASPFINGDPIRAAVDKRGTDVVTFVKYKAEGEEAKPVCAYKAESFRGVIRSAVARIHMEDGVPLTELTHSDCECLLCQIFGSEYEAGKIRFEDLVFESDPEPVTFDHVAIDRFTGGAADKKKFDDSPLPGSPARPLMLKGSFWIRRDVLEDEEYCKALGKALADVNNGLYPLGGKSAIGYGQVKSLGIKGDDKRISRLMNPAFDETDVAVPEKPKTDAEVRIEAEKVYYPHYFVEPHKKVEREEKPCGHQKFHEGRLTGKIRCKLITKTPLIVPDTSNDDFFRPADKEARKEKDEYHKSYAFFRLHKQIMIPGSELRGMVSSVYETVTNSCFRIFDETKRLSWRMDADHQNVLQDFLPGRVTADGKHIQKFSETARVPFYDKTQKHFDILDEQEIAGEKPVRMWVKRFIKRLSLVDPAKHPQKKQDNKWKRRKEGIATFIEQKNGSYYFNVVTNNGCTSFHLWHKPDNFDQEKLEGIQNGEKLDCWVRDSRYQKAFQEIPENDPDGWECKEGYLHVVGPSKVEFSDKKGDVINNFQGTLPSVPNDWKTIRTNDFKNRKRKNEPVFCCEDDKGNYYTMAKYCETFFFDLKENEEYEIPEKARIKYKELLRVYNNNPQAVPESVFQSRVARENVEKLKSGDLVYFKHNEKYVEDIVPVRISRTVDDRMIGKRMSADLRPCHGDWVEDGDLSALNAYPEKRLLLRHPKGLCPACRLFGTGSYKGRVRFGFASLENDPEWLIPGKNPGDPFHGGPVMLSLLERPRPTWSIPGSDNKFKVPGRKFYVHHHAWKTIKDGNHPTTGKAIEQSPNNRTVEALAGGNSFSFEIAFENLKEWELGLLIHSLQLEKGLAHKLGMAKSMGFGSVEIDVESVRLRKDWKQWRNGNSEIPNWLGKGFAKLKEWFRDELDFIENLKKLLWFPEGDQAPRVCYPMLRKKDDPNGNSGYEELKDGEFKKEDRQKKLTTPWTPWA

SEQ ID NO: 6 - protein, 1573 aa, Unknown
  source: /note="Description of Unknown: Candidatus Brocadia fulgida sequence"
MSKTDDKIDIKLTFLEPYRMVNWLENGLRMTDPRYLRGLSFARWHRNKNGKAGRPYITGTLLRSAVIRAAEELLSLNLGKWGKQLCCPGQFETEREMRKNKTFLRRRPTPAWSAETKKEICTTHGSACAFCLLLGRRLHGGKEDVNEDAPGSCRKPVGFGNLSLPFQPTKRQIQDVCKERVLNRVDFRTGKAQDYFRVFEIDHEDWGVYTGEITITEPRVQEMLEASLKFVDTLCGALCRIEIVGSADETKRTTSSKEGCPASTTTRDCSSSENDDTSPEDPVREDLKKIAHVIANAFQNSGNREKVHALADAIRAMRLEESSIINTLPKGKSEKTTEQIEVNKHYLWDEIPVNDTSVRHILIEQWRRWQSKKDDPEWWKFCDFLGECLYKEYKKLTSGIQSRARVMGETEYYGALGMPDKVIPLLKSDKTKEWILVGSLKAETPFFFGLETEQTEEVEHTSLRLVMDKKGRFRIPRSVLRGALRRDMRIAFDSGCDVKLGSPLPCDCSVCQVMRSITIKDSRSEAGKLPQIRHRIRLNPFSGTVDEGALFDIEVAPEGVIFPFVMRYRGEEFPPALLSVIRYWQDGKAWLGGEGATGKGRFALAKDLKMYEWKLEDKSLHAYIDTYGHRGNEHAIGTGQGIDGFRSGSLSDLLSDISKESFRDPLASYHNYLDKRWIKVGYQITIGAPLLSADPIGALLDPNNVDAIVFEKMKLDGDQVKYLPAIKGETIRGIVRTALGKRNNLLAKNDHDDCTCSLCAIFGNENETGKIRFEDLEVYDKDIAKKIDHVAIDRFTGGARDQMKFDTLPLIGSPERPLRLKGLFWMRRDVSPDEKARILLAFLEIREGLYPIGGKTGSGYGWVSDLEFDGDAPEAFKEMNSKRGKQASFKEKISFRYPSGAPKHIQNLKATSFYYPHYFLEPGSKVIREQKMIGHEQYYESYPSGASGEKLLSGRIICSMTTHTPLIVPDTGVIKDPENKHATYDFFQMNNAIMIPGSEIRGMISAVYEAMTNSCFRIFHEKQYLTRRISPEDKELREFIPGIVRIINGDVYIEKAEREYRLPLYDDVHIITNYEELEYEKYIKKNPGREQKIKNAHRFNKNIARIAESNRNYLCSLDRAVRREILSGRKKVNFRLVKVNDNKNPDKEAVELCKTGPLEGLVKFSGLNAVNISNLRPGTAEEGFDAKWDMWSLNIILNRMDVRNSQKKEYPRPALHFNHDGKEYTIPKRCERVFVRAEAGKRAETEGSYKVPRKVQEQYQNILRDYESNIGHIDNTFRTLIENCGLNNGSLVYFKPDNSRKEVVAITPVKISRKTDRLPQGDRFPHTSSDLRPCVRDCLDTEGDIRMLENSPFKRLFHIHPEGLCPACQLFGTTNYRGRVRFGFASLSDGPKWFRKDEGNETCHITLPLLERPRPTWSMPDDTSTIPGRKFYVHHMGYETVKKNQRTLVKTENNRTVKALDKENEFTFEVFFENLREWELGLLLHCLELEPEMGHKLGMGKPLGFGSVKIRIDKLQKCVVNVKDGCVLWEPEEDKIQHYIAKGLGKLTTWFGKEWDRLEHIQGLRSLQRLLPL

SEQ ID NO: 7 - protein, 1526 aa, Unknown
  source: /note="Description of Unknown: Deltaproteobacteria bacterium sequence"
FESYARWCKSNSGLWKPYIPGTLLRSAVLESVEYLLALIGSKNKVEICPGLYTQSENNPDTKYLRRRPWYELHAQKEICKTRDTACPLCLLMRTKLDNDGDGETEKNVKFGNLYPTSPLEPLQKIRPRILNRMDPGTSKARDYFRVFEIENQLCSQFRGWIWLSGDLPNMELVKSLLAAGLSNVATLAGAVCRIRIVSTDNPSMKQDLTTQDLIDDFTNYYLKGDTPPANLAASGKGDAFPRFSPGSGDHPDTTGVSHADMASSHEGTALAKDIAEKCKDILSQISASEQLRRLADIMRDLRQDSNREIMYRQVAEENHEKASLLYKKTKKGDSIAALIAGKTEGMDAETWRRLCEFLGQTFYGEAKEAGLVETPVPRILGESERYSLQKKPTVRTDLAAELVPDIEFIIKGNLIAETPFFFGTDIATETHTDLPILLTSDRHFRIPRSVLRGILRRDLRLVTGSGCSVKLGRSEPCACDVCQIMRSLTMRDCVSSCKVPPEIRHRIRLNPVTETVEEGALFDMEIGPQGISFPFVLRSRGVNSSFSTRLKNVLTWWSEGKIFMGGDKGTGKGRFTLAELEAYYFRLTTKRIGKNVWVIGNYLKSQGWRGAELETHFDSLKEWKSLSFSDSDVKVFTWHKITWKVSFEGPVLTNDPIAADIRNESDAVFYQKSVAGEKGPVYALKGEGLRGIVSSSLCKKKNLSSNLHEDCECLRCKIFGSKHQEGNIRFEDMTVSQESEVREKLFDHVSIDRFTGGAANKLKFDDKPLVGNPLVFQGVFWVHQSIGNNEKTQEALSDAFKDVRDGLYPVGAKGSIGYGWIKGIEVVEGPDWLKDALSAEKTVEAGIASEESEYKLPDLPWISLLPKGRAIYNPHYFLGIPKVTPEREREPVGHDRFQTDLHTGRIICTLKTITPLIIPDTENDKAFEVENASADHERFKFMRMGSQAAIPGSAIRSMTSSVFEALTNSCFRVLDQKSHLSWRMEADDAGDYKPGRFEKKDDKAVIRKFKKKARFPFYAGPDTREAFTSDQIMGKEKVTLWVKDFEASLTVPDEIGWKKKRGYLKVTGPNKVEIDTENISENNPSPPDSWQDVRINDDGTIPDKKNRKFICQYGTTTYTVDKWCEAFFCDEEKDPYELAPDVERKYRLLMDSYHNNPQAPPQIFRSLPLFSETGPKKTLEHGDLVYFRLSEVNKQSQSKKQVRERVTDIVPVSISRIANNQPIGKHIAAAFRPCAYVCIEECEPCDAKTCPIPVYREGYPIKGLCRACHLFGTTGYKGRVRFSFAKLNGDAVWAKGAGGKDYFTLPLLEKPRPTWTMPNEGAKIPGRKFYVHHNEWKTVQEGKNPIDQKAIRPNPNNSSVEVLNLGNEFQFEVSFENLEEWELGLLLYCLELEPGLAHKLGRGKAFGFGSIEAEVSKIEMRIKSGTWKNETSGKEKFIQSGLSQVPSFFKQDEKQWNKVEQVKNIRKLLQLSWNKGNAVEPEVRYPALREKDDENKRPGYVELKDNGYDAGKKLVSPWAPWHPIKK

SEQ ID NO: 8 - protein, 1403 aa, Unknown
  source: /note="Description of Unknown: Deltaproteobacteria bacterium RIFOXYD12_FULL_50_9 sequence"
  MOD_RES (1394)..(1396): Any amino acid
MTKKPGTEDKATLWGKESASKSVKTILEESIQGFTVEQKRSFFANLADQLVSRAGEQGAKSVRSQGLIIGRKENYAKPSAQEPTRHHLYRQPSNASAFLATGWLIAETPFFIGSGTEGQKQTDDQAESLHLRTLRDGHGRFRIPFTTIRGVMDKELRDILQAGCAKGRSLRAPCPCQVCTLMRRIQVRDAIAADILPPDLRMRTRIDPSHGTVAHLFSLEMAPQGLKLPFFLKLKGVETIDPDKELLEILNDWSAGQCFLGGLWGTGKGRFRLDDLQWHRLELDNADYYTPLLQDRFFAGETISDLRQGLQSINIQPERIPAQTPSRNMPYCRVDCILEFKSPVLSGDPVAALFESDAPDNVAYKKPVVQYDETGRLRTTDPGPVEMLTCLKGEGVRGVVAYLAGKAYDQHDLSHDSCNCTFCQAFGNGQKAGSLRFDDFMPVQFESDQAGNFSWSPHTPHAMRSDRVALDVFGGAMPEAKFDDRPLAASPGKPLNFKSTIWYREDMGKEAGKALKRALIDLQNNMAAIGSGGGIGRGWVSRVCFEGDIPDFLEDFPEPITVTEPEQDSQLLKNQAVADETAVSACDTADAPHPLAVTLEPGARYFPRVIIPRAPTVKRDECVTGQRYHTGRLSGKIFCELNTLGPLFVPDTDYSAGVPVPISDEQLAECQLQAVFENTSKFNEFFATYPEETVTKLKDLLCAADDKWILAVKDITADLRQEIGEDTFQRIIRKAGHKTQRFHQINDEIGLPGASLRGMVLSNYQILTNSCYRNLKATEEITRRMPADEAKYRKAGRVTVSGDGAQKKYSIQEMEVLRLPIYDNMNTPDNMPDVAKQATTAKRCNNLMNEAAKTSRVELKARWREGQSKIKYQIIDALNKVDPIIQVISSSKQINPNNGKTGWGYVKYTGANVFAKSLVAPIDCLRKKDAGHVCCQVNLNPAWEASNFDILINEKCPVERQSGPRPTLRCKGQDSAWYTLTKRSERIFTDKKPVPDPINIPPREVKRYNELRDSYKKNTAHVPKPLQTFFNQESLANGDLVYFEVNQFGEASQLTPVSISRTTDLFPIGGRLPQGHKDLFPCTAMCLSECKNCVPASFCEFHSRSHEKLCPACSLAGTTGNRGRIKFSEAWLSGLPKWHSVSQDNVGRGLGVTMPRLERSRRTWHLPTKDAYLLGQSIYLNHPVPAILPSDQVPSENNQTVEPLGPKNIFSFQLAFDNLSIEELGLLLYSLELESGMAHRLGRGRALGMGSVQISVKDIQIRDNKSFLFSSNISKKSEWIQCGKDEFAQEAWFGESWDNIDHIQRLRQALTIPVKGDVGCIRYPKLEAEGGMPDYIKLRKRLTPLCDREEPVRYRINPVQLARMILPFVPWHGACPALLNEQVMIEAKRLTELXXXDRANWPC

SEQ ID NO: 9 - protein, 1367 aa, Unknown
  source: /note="Description of Unknown: Deltaproteobacteria bacterium sequence"
ASEDDDTPTLRKVLKDEINGQEDMWRKFCEALGNSLYDLSKKAKERKRTEALPRLLGETEIYGLPMRENKEDEPLPSSLTYKFKWLIAGELRAETPFFFGTEVQEGQTSATILLNRDGYFRLPRSVIRGALRRDLRLVMGNDGCNMPIGGQMCECGVCRVMRHIVIEDGLSDCKIPPEVRHRIRLNCHTGTVEEGALFDMETGYQGMTFPFRLYCETENSDLDSYLWEVLNNWQNGQSLFGGDTGTGFGRFELTEPKVFLWNFSKKEKHEAYLLNRGFKGQMPVQDVKTKSFKTKTWFQIHRELDISPKKLPWYSTDYRFNVTSPLISRDPIGAMLDPRNTDAIMVRKTVFCPDPNAKNRPAPATVYMIKGESIRGILRSIVVRNEELYDTDHEDCDCILCRLFGSIHQQGSLRFEDAEVQNSVSDKKMDHVAIDRFTGGGVDQMKFDDYPLPGCPAQPLILEGKFWVKDDIDDESKSALEKAFADFRDGLVSLGGLGAIGYGQIGDFELIGGSADWLNLPKPEENRTDVPCGDRSAQGPEIKISLDADKIYHPHFFLKPSDKNVYRERELVSHAKKKGPDGKSLFTGKITCRLSTEGPVFIPDTDLGEDYFEMQASHKKHKNYGFFRINGNVAIPGSSIRGMISSVFEALTNSCFRVFDQERYLSRSEKPDPTELTKYYPGKVKRDGNKFFILKMKDFFRLPLYDFDFEGEAESLRPNYDEDRNEEENKGKNKNTQKVKNAVEFNIKMAGFAKHNRDFLKKYKEQEIKDIFMGKKKVYFTAGKHKPNEAHDNDKIALLTKGSNKKAEKGYFKFTGPGMVNVKAGVEGEECDFHIDESDPDVYWNMSSILPHNQIKWRPSQKKEYPRPVLKCVKDGTEYVMLKRSEHVFAEASSEDSYPVPGKVRKQFNSISRDNVQNTDHLSSMFQSRRLHDELSHGDLVYFRHDEKRKVTDIAYVRVSRTVDDRPMGKRFKNESLRPCNHVCVEGCDECPDRCKELEDYFSPHPEGLCPACHLFGTTDYKGRVSFGLGWHESNTPKWYMPEDNSQKGSHLTLPLLERPRPTWSMPNKKSEIPGRKFYVHHPWSVDKIRNRQFDPAKEKQPDDVIKPNENNRTVEPLGKGNEFTFEVRFNNLREWELGLLLYSLELEDNMAHKLGMGKALGMGSARIKAEAIELRCESAGQNAELKDKAAFVRKGFEFLEIDKPGENDPMNFDHIRQLRELLWFLPENVSANVRYPMLEKEDDGTPGYTDFIKQEEPSTGKRNPSYLSSEKRRNILQTPWKHWYLIPPFQASAQSETVFEGTVKWFDDKKGFGFIKINDGGKDVFVHHSSIVGTGFKSLNEGDSVAFKMGVGPKGPCAEKVKKIGN

SEQ ID NO: 10 - protein, 1322 aa, Unknown
  source: /note="Description of Unknown: Syntrophorhabdaceae bacterium PtaU1.Bin034 sequence"
MRRQRLLGDAEYYGGTGREQPASIVISTDSDPDHKVYEWIITGQLKAETGFFFGTKAGAGGHTDLSILLGKDGHYRVPRSVFRGALRRDLRVAFGAGCRVEVGRERPCECPVCKVMRQITVMDTISSYREAPEIRQRIRLNPYTGTVDKGALFDMEVGPEGIEFPFVLRFRGSKSFPSELAAVIGSWTKGTAWLGGAAATGKGRFSLLGLSIHKWNLSTAEGRKSYLAAYGLRDAADKTVKRLSIDKGGKGDVGLPAGLERDALPSSVREPLWKKLVCTVDFSSPLLLADPIAALLGVEGDERIGFDNIAYEKRRYNGETNTTESIPAVKGETFRGIVRTALGKRHGNLTRDHEDCRCRLCAVFGKEQEAGKIRFEDLMPVGAWTRKHLDHVAIDRFHGGAEENMKFDTYALAASPTNPLRMKGLIWVRSDLFETGHDGPTPPYVKDIIDALADVKRGLYPVGGKTGSGYGWIKDVTIDGLPQGLSLPPAEERVDGVNEVPPYNYSAPPDLPSAAEGEYFFPHVFIKPYDKVDRVSRLTGHDRFRQGRITGRITCTLKTLTPLIIPDSEGIQTDATGHKMCKFFSVAGKPMIPGSEIRGMISSVYEALTNSCFRVFDEEKYLTRRVQPKKGAKSSELVPGIIVWGQNGGLAVQQVKNAYRVPLYDDPAVTSAIPTEAQKNKERWESVPSVNLQGALDWNLTTANIARDNRTFLNSRPEEKDAILSGTKPISFELEGTNPNDMLVRLVPDGVDGAHSGYLKFTGLNMVLKANKKTSRKLAPSEEDVRTLAILHNDFDSRRDWRRPPNSQRYFPRSVLRFSLERSTYTIPKRCERVFEGTCGEPYSVPSDVERQYNSIIDDISKNYGRISETYLTKTANRKLTVGDLVYFIADLDKNMATHILPVFISRISDEKPLGELLPFSGKLIPCEGEPPTILKKMAPSLLTEAWRTLISTHLEGFCPACRLFGTTSYKGRIRFGFAEHTGTPKWLREELDWARPFLTLPIQERPRPTWSVPDDKSEVPGRKFYLHHHGGNRIVESNLRNRPEVNQTKNNSSVEPISAGNTFTFDVCFENLEAWELGLLLYCLELSPKLAHKLGRAKAFGFGSVKIHVERIEERTTDGAYQDVTAVKKNGWITTGHDKLREWFHRDDWEDVDHIRNLRTVLRFPDADQEHDVRYPELKANNGVSGYVELRDKMTASERQESLRTPWYRWFPQNGTGGSGRHEQAATSQEQDTAKDESVLSATQRRQAVIDVSDPDERLSGTVESFDRQKGDGYIGCGVRQFYVRLEDIRSRTALCEGQVVTFRARKEWEGHEAYDVEIDQ

SEQ ID NO: 11 - protein, 476 aa, Unknown
  source: /note="Description of Unknown: Deltaproteobacteria bacterium sequence"
MLEKALADFRDGVVSLGGLGAIGYGRIGDFEVAEESGTWLKIPEKKLPEDSVQCGERYRFSSDPATRFEKEKIYYPHYFLKPSDEDVRRETRLVSHVYQEDTDGKTRLLTGTIRCRLTTEGPIFIPDTDDPKEDYFQMEIEGHKSYGFFRINEQVAIPGSSIRGMVSSVFEALTNSCFRVFDQKRYLSRSTKPDPRELEKYLPGKVKRIDNKWVLLELEDIFRLPLYDLKDVGPKSLDSAYGLEKFKNEKRFRLKKIENAVAFNKKMAGYAKHTREFLKNNYTETELGKILRGEMKVWFTIGHKPNSAHDNDKIALLTKKTNKRAKSGFIKFTGPSMVNIKADASNSDCEECRFDMKSEDKDGLIFHNAIECRPSQKKEYPRPVLKCVKEAVEYTMIKRCEQVFSEGKKPPRSYSIPDKSRRQYNGILKDNRDNTEHIPSFFRNRMKNKELSDEDLVYFRYKGKKVTNIAPVRVSR

SEQ ID NO: 12 - protein, 437 aa, Unknown
  source: /note="Description of Unknown: Deltaproteobacteria bacterium sequence"
QYNLPLNPDAFPKFRWIVTGHLRAETPFFFGRGEIKDRTIEEETEQTSKTILLNKDNFFRLPRSVIRGALRRDLRLVIGNGCNTPVGGKFCECDVCRIMRHVVVEDTISSCRKPPEIRYNIRLNGHTRTVEEGALFDTETGYQGMRFPFRLCFETRASEFDPDTSEPIPKFDPYLSEVMKHWKAGQAVFGGDTGAGFGRFRLEGDIRFFSMDVAKKEEYDPYLLARGFKGMSSQEILEKIGSGRTYDWNSVPKIALNIPPNKLPWKEICYTIEVISPLISRDPIRAMMDPRNTDTIMIRKRVFVPDGKGGTLPEPESRYFIKSETLRGILRSLVGGNKTADGEYLCDLDHEDCDCVQCRLFGSIHQQGCLRFEDAEVWNSVRDKKMDHVAIDRFTGGALDQMKFDDYPLLGCPEYPVILGGRFWIRDDISDKEKEIA

SEQ ID NO: 13 - protein, 350 aa, Unknown
  source: /note="Description of Unknown: Syntrophorhabdaceae bacterium PtaU1.Bin034 sequence"
MESIPVTLTFLEPYRVVEWYANEDRRSAERYLRGQSFARWHRKKNDKKGRPYITGTLLRSAAIRAAEELLSLSGGVWDGQHCCKGQFLSGGVKPEYMRKRPTYIWAEKEGACSAPDYCPFCIFLGDRDQAEKKAESQNGYPDKSYHIRFGNLSLPDPPPLLDLKEVAVERTLNRVDFQTAKAHDYFKVWEISHEDLGVYTGQIVIHYTGPWQEKVKSLLEGSLRFVDRLCGALCKIEMAPKPARPLPKSLSVDMTEHAKIIVTAFDDAKKAEKVRGLADAMRSMGSKGPTILDKLPAGHDDRDHHTWDVTIVDKTPLRTYLKGVLRADDAASWPALCKALGNALYDVSQG

SEQ ID NO: 14 - protein, 348 aa, Unknown
  source: /note="Description of Unknown: Nitrospirae bacterium sequence"
EKQGFRDKGFNIVGSLKDAIGKEIGLREISLRPAKEETMPRWQCVEYTIIVNSPLHTADPIEALLHSGNYDSVVYKKTVVRNGNIKQIPVFKGETIRGIVRTAFARILRTENVEFDEEHEDCTCPLCQVFGNEHRAGRVRFEDLVIEGYTSEKKFDHVSIDRFTGGAAEKRKFDDLSLKGSPRRPIVLRGKVWIRNDMDSKGIEKLKQAFMDIRDGLYPLGSRGGIGYGWVTDLKIENTEVEEFRLDKVSTTEGSGPATEEFNFPSLPEIQLNKDAVYHPHYFIRPHEKVNREIRPVGHERFHDDLLTGRIKCTLKTLTPLIIPDTEDPDAFGLQAEHKGHQNFRFFR

SEQ ID NO: 15 - protein, 1528 aa, Unknown
  source: /note="Description of Unknown: Hydrothermal vent sediment bacterial communities from Southern Trench, Guaymas Basin, Mexico - 4870-07-3-4_MG sequence"
MKSIPITLTFLEPYRILPWAEKGKRDKKEYLRGANYVRLHKDKNGKFKPYITGTLIRSAVLSAIEMLLDITNGEWNGKECCLAKFHTEGEKPSFLRKKPIYIRAEKDEICTSRETACPLCLILGRFDKAEKKEKDKEKFDVHFSNLNLYSSKEFSTIEELAPKRALNRIEQYTGKAQDYFTVYEALNKEFWTFKGRIRIKEDIYDKVTDLLFSALRCVEKIAGALCRIEIDKEPSQQKGFVKRQLSKQAKEDIEKIFQVVKDAQKLRLLSDCFRELTRMANKDELALPLGPEDDGHYLWDKIKVEGKTLRIFLRNCFSQYKDNWLCFCDEASKKGYQKYREKRHKLTDRELPTATPKHFAEKKDPQISPIYIDKDDKVYEWIIVGRLIAQTPFHFGDEEKAEGAILLTPDNRFRLPRTALRGILRRDLKLAGASACEVEVGRSEPCPCDVCKIMRRVTLLDTVSEDLRDFLPELRKRIRINPQSGTVAEGALFDTEVGPEGLSFPFVLRYKCEKLPDSLTTVLCWWQEGLAFLSGESATGKGRFRLEINGAFVWDLQKGLFNYIKNHGFRGEERLFLEGNEAELEKMGIQINTELLQPEMIKKEKNFTDFPYDLIKYQLNISSPLLLNDPIRAIALYEGEGKAPDAVFFKKYVFENGKIEEKPCFKAESIRGIFRTAVGRIKNVLTKNHEDCICVLCHLFGNVHETGRLKFEDLKIVSGQEEKFFDHVAIDRFLGGAKEKYKFDDKPIIGAPDTPIVLEGKIWVKKDINDEAKETLSQAFSDINTGIYYLGANGSIGYGWIEEVKALKAPSWLKIKEKPNFEKDTSLNISAIMNEFKKDIQTLNLDKTYLPYGFLKLLEKVKRTSSPITHERFYENHLTGFIECSLKVLSPLIIPDTETPEKEENGHKYYHFLKIDNKPIIPGAEIRGAVSSIYEALTNSCFRVFGEKKVLSWRMEGKDAKEFMPGRVSKKKGKLYMVKMQALRLPVYDNPALANEIRSGSIYEKYKNSKVEIIFFQTVEGIRKFLRGNFNNVEWKKVLVTGIDPLAILPSQKIPGNDKWVKNLQSKISPVRGYFKFTGPNKIETKRREEEKDEKLRTKANKVSCLQKDKWYEAMHNHVEYKQDYTPPNSPKTEPLERPRNIPCFVCSDKEKIYRMTKRCERVFVSLGENAPKYEIPISAIKRYEVILSAYRENWERNKTPELFRTRLPGDGRTLNEDDLVYFRADENEKVKDIIPVCISRIVDEVPLIKRLSQELWPCVLAECPLLGFECKKCELEGLPEKIWFRINKDGLCPACRLFGTQIYKSRVRFSFAYAKNWKFYDGYITLPRLESPRATWLILKEKDKHYIKYKVCGRKFYLHNSTYEDIINNSKKEKEKKTENNASFEVLKEGEFTFKVYFENLENWELGLLLLSLTGLGEAIKIGHAKPLGFGSVKIEAKKIYFREEAGKFHPCEKADEYLKKGLNKLTSWFGKNEINEHMRNLLLFMTYYQNLPKVKYPDFDGYAKWRCSYVEQDKVEYFQNRWIVAS

SEQ ID NO: 16 - protein, 1652 aa, Unknown
  source: /note="Description of Unknown: Sorted cell/s from Southern Trench hydrothermal vent microbial mat, Guaymas Basin, Mexico - 6X_4868_18_01 sequence"
MIINITVKFLGPFRMLEWTDPDNRNRKNREFMRGQAFARWHNSNPQKGSQPYITGTLVRSAVIRSAENLLMLSEGKVGKEKCCPGEFRTENRKKRDAMLHLRQRSTLQWKTDKPLCNGKSLCPICELLGRRIGKTDEVKKKGDFRIHFGNLTPLNRYDDPSDIGTQRTLNRVDYATGKAHDFFKVWEIDHSLLSVFQGKISIADNIGDGATKLLEDSLRFTDRLCGAICVISYDCIENSDGKENGKTGEAAHIMGESDAGKTDAENIANAIADMMGTAGEPEKLRILADAVRALRIGKNTVSQLPLDHEGKENHHLWDIGEGKSIRELLLEKAESLPSDQWRKFCEDVGEILYLKSKDPTGGLTVSQRILGDEAFWSKADRQLNPSAVSIPVTTETLICGKLISETPFFFGTEIEDAKHTNLKVLLDRQNRYRLPRSAIRGVLRRDLRTAFGGKGCNVELGGRPCLCDVCRIMRGITIMDARSEYAEPPEIRHRIRLNPYTGTVAEGALFDMELGPQGLSFDFILRYRGKGKSIPKALRNVLKWWTKGQAFLSGAASTGKGIFRLDDLKYISFDLSDKDKRKDYLDNYGWRNRIEALSLEKMPLDRMNDYAEPLWQKVSVEIEIGSPFLNGDPIRALIEKDGSDIVSFRKYADDSGKEVYAYKAESFRGVVRAALARQHFDKEGKPLDKEGKPLLTLIHQDCECLICRLFGSEHETGRLRFEDLLFDPQPEPMIFDHVAIDRFTGGAVDKKKFDDCSLPGTPGHPLTLKGCFWIRKELEKPDEDKSEREALSKALADIHNGLYPLGGKGAIGYGQVMNLKIKGAGDVIKAALQSESSRMSASEPEHKKPDSGLKLSFDDKKAVYYPHYFLKPAAEEVNRKPIPTGHETLNSGLLTGKIRCRLTTRTPLIVPDTSNDDFFQTGVEGHESYAFFSVNGDIMLPGSEIRGMLSSVYEALTNSCFRVFDEGYRLSWRMEADRNVLMQFKPGRVTDNGLRIEEMKEYRYPFYDRDCSDKKSQEAYFDEWERSITLTDDSLEKMAERKGDISPKDLKVLKSLKGKNYKSTEGLLAAFKDKGGDTGGNILGLIFKYAERIGDVPRYEHPTDTDRMMLSLSEYNRNQKSDGKRAYKIIKPASKLGKGAYFMFAGTSVENKRICNPACTDKANKSVKGYLKISGPNKLEKYNISEPELDGVPEDRNCQIIHNRIYLRKIFVANAKKRKERDRLVGEFACYDPEKKVTYSMTKRCERIFIKDRGRTLPITHEASELFEILVQEYRENAKRQDTPEVFQTLLPDNGRLNPGDLVYFREEKGKTVEIIPVRISRKIDDSPIGKRLREDLRPCHGEWIEGDDLSQLSEYPEKKLFTRNTEGLCPACRLFGTGAYKGRLRFGFAKLENDPKWLMKNSDGPSHGGPLTLPLLERPRPTWSMPDDTLNRLKKDGKQEPKKQKGKKGPQVPGRKFYVHHDGWKEINCGCHPTTKENIVQNQNNRTVEPLDKGNTFSFEICFENLEPYELGLLLYTLELEKGLAHKLGMAKPMGFGSIDIEVENVSLRTDSGQWKDANEQISEWTDKGKKDAGKWFKTDWEAAEHIKNLKKLLFLPGEEQNPRVIYPALKQKDIPNSRLPGYEELKKNLNMEKRKEMLTTPWAPWHPIKK

SEQ ID NO: 17 - protein, 1723 aa, Unknown
  source: /note="Description of Unknown: Hydrothermal vent microbial mat bacterial communities from Southern Trench, Guaymas Basin, Mexico - 4869-18-0-1_MG sequence"
MTQITIQVTFFHPFRVVPWNHRDHRKTDRKYLRGGTFAKWHCTASEGKSGRPYITGTLLRSALFAEIEKLIAFHDPFKCCRGKDKTENGNAKPLFLRRRPRADCDPCGTCPLCLLMGRSDTVRRDAKKQKKDWSVHFCNLREATERSFNWKETAIERIVNRVDPSSGKAKDYMRIWEIDPLVCSQFNGIITINLDTDNAGKVKLLMAAGLAQINILAGSICRADIISEDHDALIKQFMAIDVREPEVSTSFPLQDDELNNAPAGCGDDEISTDQPVGHNLVDRVRISKIAESIEDVFSQEQKAQQLRRMADAIRDLRRSKPDETTLDALPKGKTDKDNSVWDKPLKKDILPSPRMPASEDDDTPTLRKVLKDEINGQEDMWRKFCEALGNSLYDLSKKAKERKRTEALPRLLGETEIYGLPMRENKEDEPLPSSLTYKFKWLIAGELRAETPFFFGTEVQEGQTSATILLNRDGYFRLPRSVIRGALRRDLRLVMGNDGCNMPIGGQMCECGVCRVMRHIVIEDGLSDCKIPPEVRHRIRLNCHTGTVEEGALFDMETGYQGMTFPFRLYCETENSDLDSYLWEVLNNWQNGQSLFGGDTGTGFGRFELTEPKVFLWNFSKKEKHEAYLLNRGFKGQMPVQDVKTKSFKTKTWFQIHRELDISPKKLPWYSTDYRFNVTSPLISRDPIGAMLDPRNTDAIMVRKTVFCPDPNAKNRPAPATVYMIKGESIRGILRSIVVRNEELYDTDHEDCDCILCRLFGSIHQQGSLRFEDAEVQNSVSDKKMDHVAIDRFTGGGVDQMKFDDYPLPGCPAQPLILEGKFWVKDDIDDESKSALEKAFADFRDGLVSLGGLGAIGYGQIGDFELIGGSADWLNLPKPEENRTDVPCGDRSAQGPEIKISLDADKIYHPHFFLKPSDKNVYRERELVSHAKKKGPDGKSLFTGKITCRLSTEGPVFIPDTDLGEDYFEMQASHKKHKNYGFFRINGNVAIPGSSIRGMISSVFEALTNSCFRVFDQERYLSRSEKPDPTELTKYYPGKVKRDGNKFFILKMKDFFRLPLYDFDFEGEAESLRPNYDEDRNEEENKGKNKNTQKVKNAVEFNIKMAGFAKHNRDFLKKYKEQEIKDIFMGKKKVYFTAGKHKPNEAHDNDKIALLTKGSNKKAEKGYFKFTGPGMVNVKAGVEGEECDFHIDESDPDVYWNMSSILPHNQIKWRPSQKKEYPRPVLKCVKDGTEYVMLKRSEHVFAEASSEDSYPVPGKVRKQFNSISRDNVQNTDHLSSMFQSRRLHDELSHGDLVYFRHDEKRKVTDIAYVRVSRTVDDRPMGKRFKNESLRPCNHVCVEGCDECPDRCKELEDYFSPHPEGLCPACHLFGTTDYKGRVSFGLGWHESNTPKWYMPEDNSQKGSHLTLPLLERPRPTWSMPNKKSEIPGRKFYVHHPWSVDKIRNRQFDPAKEKQPDDVIKPNENNRTVEPLGKGNEFTFEVRFNNLREWELGLLLYSLELEDNMAHKLGMGKALGMGSARIKAEAIELRCESAGQNAELKDKAAFVRKGFEFLEIDKPGENDPMNFDHIRQLRELLWFLPENVSANVRYPMLEKEDDGTPGYTDFIKQEEPSTGKRNPSYLSSEKRRNILQTPWKHWYLIPPFQASAQSETVFEGTVKWFDDKKGFGFIKINDGGKDVFVHHSSIVGTGFKSLNEGDSVAFKMGVGPKGPCAEKVKKIGN

SEQ ID NO: 18 - protein, 1548 aa, Unknown
  source: /note="Description of Unknown: Hydrothermal sediment microbial communities from Guaymas Basin, California, USA 4484. Combined assembly of Gp0115313 and Gp0146561 sequence"
MTKIPISLTFLEPFRLVDWVSESERDKSEFLRGLSFARWHRIKNQREDENQGRPYITGTLLRSAVIKAAEELIFLNGGKWQSEECCNGQFKGSKAKYRKVECPRRRHRATLKWTDNTCSDYHNACPFCLLLGCLKPNSKENSDIHFSNLSLPNKQIFKNPPEIGIRRILNRVDFTTGKAQDYFYVWEVEHSMCPKFQGTVKINEDMPKYNVVKDLLISSIQFVDKLCGALCVIEIGKTKNYICQSFSSNIPEEEIKKLAQEIRDILKGEDALDKMRVLADTVLQMRTKGPEIVNELPRGIEKKGGHWLWDKLRLRKKFKEIANNYKDSWQELCEKLGNELYISYKELTGGIAVKKRIIGETEYRKIPEQEISFLPSKAGYSYEWIILGKLISENPFFFGKETKTEEQIDMQILLTKDGRYRLPRSVLRGALRRDLRLVIGSGCDVELGSKRPCPCPVCRIMRRVTLKDARSDYCKPPEVRKRIRINPLTGTVQKGALFTMEVAPEGISFPFQLRFRGEDKFHDALQNVLVWWKEGKLFLGGGASTGKGRFKLEIEHVLKWDLKNNFHSYLQYKGLRDKGDFNSIKEIEGLKVETEEFKVKKPFPWSCVEYTIFIESPFVSGDPVEAVLDSSNTDLVTFKKYKLEESKEVFAIKGESIRGVFRTAVGKNEGKLTTENEHEDCTCILCRLFGNEHETGKVRFEDLELINDSAPKRLDHVAIDRFTGGAKEQAKFDDSPLIGSPDSPLEFTGIVWVRDDIDEEEKKALKSAFLDIKSGYYPLGGKKGVGYGWVSNLKIESGPEWLRLEVQEKSSQENVLSPVILSEVMDIEFNPPKIDENGVYFPYAFLRPLNEVKRTREPIGHNEWKKSLISGYLTCRLELLTPLIIPDTSEEVIKEKVNNGEHPVYKFFRLGGHLCIPAAEIRGMISSVYEALTNSCFRVFDEKRLISWRMTAEEAKRPDPKKSEEQNRMRFRPGRIIKKDKKFYAQEMLELRIPVYDNKDKRNEISQNDPTRPSEYNHPTEPERIFFSNAEKIRNFLKRNSNYLHGSTPLLFRQWSISNRYDKIALIGNKSQGHLKFTGPNKIEVSEGTKCPKYETIPGRDEWDKAVHNYVEPGKFVTVISRKKGQKPKAVQRRRNVPAFCCYDYNTNRCFVMNKRCERVFKVSRDKPKYEIPPDAIRRYEHVLRKYRENWERYDIPEVFRTRLPGDGETLNEGDLVYFRLDENNRVLDIIPVSISRISDTQYLGRRLPDHLRSCVRECLYEGWGDCKPCKLSLFPEKMWIRINPEGLCPACHLFGTQVYKGRVRFGFARAGSNWKFREEQLTLPRFETPRPTWVIPKRKDEYQIPGRKFYLHHNGWEEIYKKNKKNEIKKEKNNATFEVLKQGTFYFKVFFENLELWELGLLIFSAELGGEEFAHKLGHGKALGFGSVKISVDKIILRRDPGQFEQRGQKFKRDAVDKGFCVLENRFGKTNFKIYLNNFLQLLYWPNNKKVKVRYPYLRQEDDPEKLPGYVELKKHQMLKDDNRYSLFARPRAVWLKWTEMVQRDKS

SEQ ID NO: 19 - protein, 1720 aa, Unknown
  source: /note="Description of Unknown: Hydrocarbon resource environments microbial communities from Canada and USA sequence"
MSVEEFYVRLTFLEPFRVVPWVRNGDERKGDRIYQRGGTYARWHKINDSHGQPYITGTMLRSAVLREIENTLTLHNTYGCCPGGTRTTEGKLEKPLYLRRRDGFEFENHAEKPCSEEDPCPLCLIQGRFDKLRRDEKKQFVRQGNISFCSVNFSNLNISSGIKSFSWEEIAVSRVVNRVDPNSGKAKDFFRVWEIDHKLCPNFLGKMSISLSEKLEDVKALLAVGLAQVNVLSGALCRVDIIDPETQKDTVHQHLIQQFVTRIQDKEKGDAADIPAFTLPPAGLSPSSNEWNDTIKSLAEKIRKIKELEQGQKLRQMADVIRELRRKTPAYLDQLPAGKPEGRESIWEKTPTGETLTLRQLLKSANVPGESWRAFCEELGEQLYRLEKNLYSHARPLPRLLGETEFYGQPARKSDDPPMIRASYRAFPSYVWVLDGILRAETPFYFGTETSEGQTSQAIILCPDGSYRLPRSLLRGVIRRDLRAILGTGCNVSLGKVRPCSCPVCEIMRRITVQQGVSSYREPAEVRQRIRSNPHTGTVEEGALFDLETGPQGMTFPFRLYFRTRSPYIDRALWLTINHWQEGKAIFGGDIGVGMGRFRLENLQIRSADLVSRRDFSLYLRARGLKGLSREEVTRIGLNEEQWEAVMADDPGTHYNPFPWEKISYTLLIHSPLISNDPIAAMLDHDNKDAVMVQKTVLFVDESGNYSQMPHHFLKGSGIRGACRFLLGRKDAPNENGLTYFEADHEECDCLLCSLFGSKHYQGKLRFEDAELQDEVEAIKCDHVAIDRFHGGTVHRMKYDDYPLPGSPNRPLRIKGNIWVKRDLSDTEKEAVKDVLTELRDGLIPLGANGGAGYGRIQRLMIDDGPGWLALPERKEDERPQPSFSPVSLGPVHVNLKSGSDTADVYYYHPHYFLEPPSQTVSRELDIISHARTRDSGGEALLTGRILCRLITRGPIFIPDTNNDNAFGLEGGIGHKNYRFFRINDELAIPGSELRGMVSSVYEALTNSCFRIMEEGRYLSRRMGADEFKDFHPGIVVDGAKIREMKRYRLPLYDTPDKTSRTKEMTCPELFTRKDGRPERAKKFNEEIAKVAVQNRAYLLSLDEKERREVLLGNREVTFDECPDDEYSDDEYSELKYAQKYKDFIAVLKKNGQKRGYIKFTGPNTANKKNEDAPDKNYRSDWDPFKLNILLESDPECRVSNIHCYPRPLLVCIKDKAEYRIHKRCEAIFCSIGSPSDLYDIPQKVSNQYRTILQDYNDNTGKIVEIFRTQIKHDQLTTGDLVYFKPAANGQVNAVIPVSISRKTDENPLAKRFKNDSLRPCAGLCVEDCNECPARCKKVADYFNPHPRGLCPACHLFGTTFYKGRVRFGFAWLTGEDGAPRWYKGPDPCDSGKGRPMTIPLLERPRPTWSIPDNSFDIPGRKFYVHHPYSVDGIDGETRTPNNRTIEPLAEGNEFVFDIDFENLRDWELGLLLYSLELEDSLAHKLGLGKPLGFGTVQINIRGISLKNGSKGWDTKTGDDKNQWIKKGFAHLGIDIKEANERPYIKQLRELLWVPTGDNLPHVRYPELESKTKDVPGYTSLLKEKDLADRVSLLKAPWKPWKPWSGTAPHPDKGTNRLRASIVERDRIQRKTDTAKPEKKEETKVGKSSSSDIEKRYVGTVKWFNDKKGYGFILYGTDEEIFVHRSGVADNSIPKEGQKVGFRIERGARGSHAVEVKAIE

SEQ ID NO: 20 - protein, 1610 aa, Unknown
  source: /note="Description of Unknown: Freshwater metagenome sequence"
MPRFQLSLTFFDEPFRLIEWTDKSNRNSANTQWMRGQGFARWHKITLEKGFPFVTGTAVRSKIIREVEALLSRNKGTWNGIPCCSGFFDTKGPSPTHLRYRPTLEWEYGKTVCTSEADVCPLCLLLGRFDQAGKKSDTPCQSTDYHVHWENLSAGVAQYRLEDIAQKRTSNRVDFFSKKAHDHYGVWEVTAVKNLLGYIYISDAITESHQKTVISLLKAALSFTDTLCGANCKLELSDEPVDSIHSNQSASNFNPHSGAAPSQCSQSMPPFNMDQETKELANTLCKAFTGNMRHLRTLADAVREMRRMSPGISSLPRGRLNKEGEITAHYLWDERIDEKTIRQVLEDTIELSPARSIIYKNWISFCNQLGQKLYERAKDNDPILERKRPLGEAAFSKVPTSSHAPRHDMNSRVKGGFTREWIIVGTLRALTPFYMGTGSQAGKQTSMPTLQDSNDHFRLPRTALRGALRRDINQASDGMGCVVELGPHNLCSCPVCQVLRQIRLLDTKSKFSMPPAIRQKICKNPVLSIVNEGSLFDVELGIEGETFPFVMRYRGGAKIPDTIITVLSWWKNERLFIGGESGTGRGRFVLECPRIFCWDVEKGQNDYIQYHGFRNKEDELLSVYSTVSGLAEKNDVNLNNARDFSFDKICWEVQFDGPVLTGDPLAALFHGNTDSVFYKKPILKSGEKEPSYQWAIKSDTVRGLIRSAFGKRDALLIKSHEDCDCLLCEAFGSKHHEGKLRFEDLTPKSDEIKTYRMDHVAIDRISGGAVDQCKYDDEPLVGTSKHPLVFKGMFWINRDSSVEMQRALIAAFKEIRDGLYPLGSNGGTGYGWISHLAITNGPDWLNLEEVPLPQPTADIPVEECTAEPYPKFQKPDLDQNAVYYPHYFLQPGKPAERERHPVSHDHIDDKLLTGRLVCTLTTKTPLIIPDTQTNTMLPPNDAPEGHKSFRFFRIDDEVLIPGSEIRGMVSTVFEALTGSCFRVINQKAHLSWRINADMAKHYRPGRIIQNNEKMFIQPYKMFRLPFYAGFDPRNCLSEKQLLGIEPVKLWVKDFVASLVKPQTDIDIEWKEKIGFVRVTGPNKVEVDSSNTPDPSLPECESDWKDIHITEDGSTPSKNDRVYRCQLKGVTYTVAKWCEAFWVKDEGKKPITVNAEAINRYHLIMKSYQDNPQSPPIIFRSLPVLNYKQDQKIIGSMIFYRESAKSDKIVNEIIPVKISRTADTELLAKHLPNNDFLPCAATCLNECDTCNAKTCKFLPLYREGYPVNGLCPSCHLFGTTGYQGRVRFGFAKMNGNAKFCQGGERPEDRAVTLPLQERPKLTWVMPNENSTIPGRKFFLHHQGWKKIVDEGKNPINGDVIEPDANNRTVEPLAAGNDFSFEVFFENLREWELGLLRYTLELESELAHKLGMGKAFGFGSVKIKIKSVDLRKQGEWEKATNTLVSEDKKSSWYNIHTVNNLRTALYYVEDDKIQVNYPKLKKDNESDNRPGYVEMKKTAFPVRDILTTPWWPWWPPTPPPMNQSGNQSYARSEEPARITESQPEVYKTGTVKFYKHDKKFGFITMDGRENIHFAGNQICRPETSLQSGDKVKFIEGENYKGPTALKVERLKG

SEQ ID NO: 21 - protein, 1575 aa, Unknown
  source: /note="Description of Unknown: soil metagenome sequence"
MRLKINIHFLEPFRLIEWHEQDRRNKGNSRWQRGQSFARWHRRKDNDQGRPYITGTLLRSVVIRAVEEELARPDTAWQSCGGLFITPDGQTKPQHLRHRATVRARQTAKDKCADRQSACPFCLLLGRFDQVGKDGDKKGEGLRFDVRFSNLDLPKDFSPRDFDGPQEIGSRRTINRVDDETGKAHDFFSIWEVDAVREFQGEIVLAADLPSRDQVESLLHHALGFVDRLCGARCVISIADQKPAEREERTVAAGDEKATIADYDQVKGLPYTRLRPLADAVRNLRQLDLAELNKPDGKFLPPGRVNKDGRRVPHYVWDIPLGKGDTLRKRLEFLAASCEGDQAKWRNICESEGQALYEKSKKLKDSPAAPGRHLGAAEQVRPPQPPVSYSEESINSDLPLAEWIITGTLRAETPFAIGMDAPIDDDQTSSRTLVDRDGRYRLPRSTLRGILRRDLSLASGDQGCQVRLGPERPCTCPVCLILRQVVIADTVSETTVPADIRQRIRRNPITGTAADGGLFDTERGPKGAGFPFSLRYRGHAPMPKALRTVLQWWSAGKCFAGSDGGVGCGRFALDNLEVYRWDLGTFAFRQAYSENNGLRSPEEEFDLAVIHELAEGLAKEDGQKILKGTEPFTCWQERSWQFSFTGPLLQGDPLAALNSDTADIISFRRTVVDNGEVLREPVLRGEGLRGLLRTAVGRVAGDDLLTRSHQDCKCEICQLFGSEHRAGILRFEDLPPVSPTTVADKRLDHVAIDRFDQSVVEKYDDRPLVGSPKQPLVFKGCFWVQTSGMTHQLTELLAQAWRDIAAGHYPVGGKGGIGYGWINSLVVDGEKITCRPDGDSISLTTVTGDIPPRPALTPPAGAIYYPHYFLPPNPEHKPKRSDKIIGHHTFATDPDSFTGRITCKLEVVTPLIVPDTEGEQPKDQHKNFPFFKINDEIMLPGAPLWAAVSQVYEALTNSCFRVMKQKRFLSWRMEAEDYKDFYPGRVLDGGKQIKKMGDKAIRMPLYDDSTATGSIKDDQLISDCCPKSDEKLQKALATNQKIALAAKHNQEYLAQLSPDEREEALQGLKKVSFWTESLANNEAPPFLIAKLGEERGKPKRAGYLKITGPNNANIANTNNPDDGGYIPSWKDQFDYSFRLLGPPRCLPNTKGNREYPRPGFTCVIDGKEYSLTKRCERIFEDISGGENQVVRAVTERVREQYREILASYRANAAGIAEGFRTRMYDTEELRENDLVYFKTAKQADGKERVVAISPVCISREADDRPLGKRLPAGFQPCSHVCLEDCNTCSAKNCPVPLYREGWPVNGLCPACRLFGAQMYKGRVNFGFARLPDDKQPETKTLTLPLLERPRPTWVLPKSVKGSNTEDATIPGRKFYLRHDGWRIVMAGTNPITGESIEKTANNATVEAIMPGATFTFDIVCENLDQQELGLLLYSLELEEGMSHTLGRGKPLGFGNVRIKVEKIEKRLSDGSRREMIPPKGAGLFMTDKVQDALRGLTEGGDWHQRPHISGLRRLLTRYPEIKARYPKLSQGEDKEPGYIELKSQKDENGVPIYNPNRELRVSENGPLPWFLLAKK

SEQ ID NO: 22 - protein, 1237 aa, Unknown
  source: /note="Description of Unknown: groundwater metagenome sequence"
MSNQTRWIIEGTLELITPLHIGTGLDEKERDENKETRWLEAVALDHKGQPYIPGASLKGALRALAKRHDFRNLFDNKEVDGDFVRQAEFLSAWCVPDTDKGRLIQPRVAIDRVTGTAQDKKLFQTRLITPGTRFAMKIVVQNAVENEIADLLGLLNLLPDDPQFSLGAYANQGQGRVQWFGKIQTRCFGINEAKAWYEEIRKDESKCWTAFAKPKNVSTPPTPAKEAQLTLPLNLAFHTPFLVKQAGIKADDADAVPRRTHDDKIVLPASSLRGRLRTQSERILRTLGCETPQGHTAPAYRKGQPHDDLAVLLFGAAGWRGIVQTSDCIVEDKSIKTRRHEMLAIDRFTGGGKDGAKFNVDYVECPTLAGKLSLDLARLKNAKLKGGKDALLPALGLMTLMLRDLAEGDIPFGYGISKGYGQCRASSALGDWAELLKQHLGADSADTTVQALREYLGNPKGQELKLDPPSADATQAGVPAQQNAAKTQAQGAQEKFHNPYHFIPLSKPDISQWPEPQKLTEKGHSHDRYASLSGRIVCRLTTQTPLFIGSEQTTPTNPQAPKSLHPFKLNNGLAIPATSLRGMISSLFESVSNSNFRVLDEKTYSMRKTMQQSLSAMGRIVRHDQKLYLLPLTLPTLPQGPHGVYDLGEKWSAVFDWQPPPLRIYFDPPPRRTYQSQQPCYMKLSTVKYSESNPNQIIAGENLGALRFPRGNQNTQFLIGQSNQDECPITQAEYAQKSEDERNEYTSGWVRTLVKPGRDLPRSVKHHVFLPDVFIDAPPPVNDLYPIPDSVIQRFHDLADQVLASMNLKPEEIVDSTNLLPYTPVGRRSDSDCRDTRLQAGDLIFFDIDPPLHPGEKSQITEISFSSIWRSGIGKDHLLTTPDLLTNFDVNLQPHGMPGRTQSLSPAELLFGLVGTQNDQATTAYAGKVRIGFGLPEEGHNPRLDARITLKELSSPKPPSPALYFRKKSGKDEYVSKANLADKPEDYILRGRKMYLHAWRKNEQVVELSDTGHDGGVRPPWVSKFDESADEGNKRRVSIEPIAKDESFYFEVDFHNLSRTELAQLCATLYPNEKFEHRLGMGKPLGLGSIKITPLSLFLVNRSQRYATDGLDKPRYHAVWHTGTASEPRWPDHLQREQQGIAFEGVSTAPTVMSLAAEAKVSDDVKRALELLGNPDEITVPVHYPQLHNGLMESKQFDWFVQNDKSGRDQPANNRQHLSSFTKDTEKLEPLIRIMRR

SEQ ID NO: 23 - protein, 1291 aa, Unknown
  source: /note="Description of Unknown: wastewater metagenome sequence"
MTTPSAPKSSLPALHWLIRAELEVLTPLHLGTGTDQRITPDAPDADPYWQADIALDADGRPYLPGASLKGALKALARRRQVDAPCLPLFGDLNRGGAPHPDCIPPRRTRAGLAEFRDALQSHATQADGPDTAQPRIAIDRITGSVVDKKLFHTQTVPVGTRFSVEIILRRADQNLAAQLVALLQHGPTDPDFRLGAHANLGFGRVGLYGNIDTRRFGPQQAQHWFAAAQTQADARWTDFAEAVTLTAPAPAPAQPAPHRLALPLSLTFHTPFLVKQPEHKHRKPQDNAPDGTPRQRGDRALLPGASLRGRLRSQAERILRTLGCKVAQGHAVPPVKNNTCPDPATLLFGTAGWRGLLRTDDCTGTAPATLVDHDMLAIDRFTGGGKDGAKFKLRYAECPTLEGQLSLDLSRLRSARLDGANAADTPWIALGLLTLVLRDLAEGDIPFGHGSAKGYGRCRAQGLPDRWRQALEAHFGPNADARALAALRAWCRTHATAALDAPCSLAGSAPTPAAAAPSGQAAPADAFHNPYHFIPFSQPDIDRWLSPDAHRKTGGHSRYRGLSGRLVCALTTVTPLFVGAAARTPASDQHPKPVAGFALQNQPAIPATSLRGLLSSLFESISGSNLRVLHPTPYSIRKTTKEALSAIGRIVERNGELKLYPLTLPTIHQNADNAYPVPARWRKVFYWESPVPLRVYFGSRKQTYDSRQPHYLPIQELSYLPNDSDCIAPDQGDLRFPSRDRDRKFLIGQCPISRYDCPIPETDLPKLSPQERPRYTRGWVRSLWTSNREKELPHTVKHQLFIPDPVETPAADDLLPIPQGVLDTFHALADLALAGQHWGKDETPADDQLLPFTPAGRQRHDADRPPRDADRQTRLQPGDLVCFDLGDDGAVSEISFSSIWREGLRLAGKPNLATTADLLAQVSPHLLPLGMPGRSARLSPVEQLFGVVEYRPPQTAKGTRKPTDAPAAYALAGKLQVGFGRPARPFEREPAVTLKELSTPKPPSPALYFRPKAGDGYVSKAKLASQPQDYAPAGRKHYLHALRRQGQVARLDNSGHVPSDGSGRPPWQSRFDGQEDSGNKRRVRVEPIPAGETFHFEIDFDNLSPTELEQLCATLLPHPAFEHRLGMGKPIGLGSVKLAVEGLLLVDRPRRYAEDEPNAPRHHRGWRANADAGWPDHLQGDSPAAPLEATEQPAALAERAMARVPADVRRALQLLGNPGAVAAPVHYPQVKDAQIEEKHYLWFVANDDEKTAGGNRHLPRLHANSPGLPTLPRLVKREKDHSSNTGKPRRK

SEQ ID NO: 24 - protein, 1801 aa, Unknown
  source: /note="Description of Unknown: oral metagenome sequence"
MIPDLRSLVVHISFLTPYRQAPWFPPEKRRNNNRDWLRMQSYARWHKVAPEEGHPFITGTLLRSRVIRAVEEELCLANGIWRGVACCPGEFNSQAKKKPKHLRRRTTLQWYPEGAKSCSKQDGRENACPFCLLLDRFGGEKSEEGRKKNNDYDVHFSNLNPFYPGSSPKVWSGPEEIGRLRTLNRIDRLTTKAQDFFRIYEVDQVRDFFGTITLAGDLPRKVDVEFLLRRGLGFVSTLCGAQCEIKVVDLKKKQNNKEDSILPVSEVPFFLEPEVLAKMCQDVFPSGKLRMLADVILRLREEGPDNLTLPMGSQGLGGRLPHHLWDVPLVSKDRETQTLRSCLEKIAAQCKSEQTQFRLFCQKLGSSLFRINKGVYLAPNSKISPEPCLDPSKTIRTKGPVPGKQKHRFSLLPPFEWIITGTLKAQTPFFIPDEQGSHDHTSRKILLTRDFYYRLPRSLLRGIIRRDLHEATDKGGCRVELAPDVPCTCQVCRLLGRMLLADTTSTTKVAPDMRHRVGVDRSCGIVRDGALFDTEYGIEGVCFPLEIRYRGNKDLEGPIRQLLSWWQQGLLFLGGDFGIGKGRFRLENMKIHRWDLRDESARADYVQKCGLRRGVGDDTAINLEKDLSLNLPESGYPWKKHAWKLSFQVPLLTADPIMAQTRHEEDSVYFQKRIFTSDGRVVLVPALRGEGLRGLLRTAVSRAYGISLINDEHEDCDCPLCKIFGNEHHAGMLRFDDMVPVGTWNDKKIDHVSCSRFDASVVNKFDDRSLVGSPDSPLHFEGTFWLHRDFQNDVEIKTALQDFADGLYSIGGKGGIGYGWLFDMEIPRSLRKLNSGFREASSIQDALLDSAKEIPLSAPLTFTPVKGAVYNPYYYLPFPAEKPERCLVPPSHARLQSDRYTGCLTCELETVSPLLLPDTCREKDGNYKEYPSFRLNNTPMIPGAGLRAAVSQVYEVLTNSCIRIMDQGQTLSWRMSTSEHKDYQPGKITDNGRKIQPMGKQAIRLPLYDEVIHHVSTPGDTDDLEKLKAIVLELTRPWKELPEEQKKKRFEKCKNILDGRMLQQKELRALENSGFAYWRDKTSLTFDSFLKDAIEQEYPRYSGDYQRIKALVVNITLPWKLLKKEERHKRFDKCRRILKGQQPLTKDERKALEESGFANWHGRELLFDRFLKDENSCLIKAETTDRVIASVAKNNRDYLFEIKQQDFARYKRIIQGLERVPFSLRSLAKSKETSFQIACLGLRRGRFLRKGYLKISGPNNANVEISGGSHSNSGYSDIWDDPLDFSFRLSGKSELRPNTQKTREYPRPSFTCTVDGKQYTVNKRCERVFEDSAAPAIELPRMVREGYKGILTDYEQNAKHIPQGFQTRFSSYRELNDGDLVYYKTDSQGRVTDLAPVCLSRLADDRPLGKRLPEEYRPCAHVCLEECDPCTGKDCPVPIYREGYPARGFCPACQLFGTQMYKGRVRFSFGVPVNSTRSPQLKYVTLPSQERPRPTWVLPESCKGKEKDVPGRKFYLRHDGWREMWGDDDKPDSRPSSEECQDIIEGIGPGEKFHFRVAFENLDKNELGRLLYSLELDAGMNHHLGRGKAFGFGQVKIRVTKLERRLEPGQWRSEKICTDLPVTSSELVISSLKKVEERRKLLRLVMTPYKGLTACYPGLERENGRPGYTDLKMLATYDPYRELVVQIGSNQPLRPWYEPGKSFKPSPGNDCTGRGGSVSKSLISEPKVVPAIAPFCEGVVKWFNSVKGFGFIETKEQRDIFVHFSAIRGEGYKILEPGEKVRFEIGEGRKGPQAINVIRIR

SEQ ID NO: 25 - protein, 1322 aa, Unknown
  source: /note="Description of Unknown: hydrothermal vent metagenome sequence"
MKMNKTWPFREHWEISGYLRTVTPLHIGSGRTVTRPELTVADRDELVDINAVVTDYTGKPYLPGSTIKGALHAWLQKRLKEESRTCLIQLFGQEEEAEEKKKNNHGGKAEFFDARVIFPHTGPGSLPYWDDCRQTYVAATVAIDNITRTARHRHLIHAEMVPPGVTFALTLAGPLDEEDIGLLLAALQGFNESPPALVIGAHTANGLGRFSWELSTVRRFGKEHLQGWLEAETRAMRTEAMQPLSREGVEDLLQDGIAQIDHNEDQVRLGLELCFDGPFLVNDPPTKKEQDDKKKRRSNTPNLRPLRDAIGRPCLPESSVRGALRAQAERIIRTMEGTCSEDNPAYKKEIHTDAEIEELSAVCRVFGAPGWKSLLEISDFEFVDGEDCDNIQEFVAIDRFTGGAKDKAKFNAEYIGSPRFTGTIALDKRRDLPDWGKGLLYLVLRDLAEGDITLGFGRSKGYGVCRAKIKNLDLLLPEKSVAALHKKFAISPADDKPATDQIAEDTTSGNLGISAGGPAQKTTESYEPPNPSGPGTFHNPYHFVPVVKPSAADRQHWLDKGILPSASENKTQHTHACYLDTTNGKKIYHGRIVCRLQAETPMFIGGRHRENTEPTEILPFTLGGKPAIPATSLRGMLSSIAEAASNSSLRVLEDKTLSYRKSMRANRNEDKPLSALGMIKKIETGDKVEYRLLPLTLPTLVKRGQYYILPEEYQTMFPDGRAKLKVYLNSNYTASDGTNQDFLKGKKSWRLPHGEIYYMKLCQDFSLQNGQLTFDSQNQNMLHFPKNRNNFVVGQRSIDNTPPMTKAEWRTNHQTGVPGMLRIMQASGRNFPTGRYHEIFIPVPTKKDCKQLYPVDEKAVERFLDLAGEQTKSQQNEKNLKQYQILPYHPVGTKRNTDPETNDRYMDLNSGDIVYFRPDATGTKVEEISFSSIWRDRVEDDNHNRAGVHAFFGNIDKELLPFNPKRAEISPAELLFGFVEERERGKVDDGQAPAFAGKVRVSFGRLSSEKKPDTIFQDQVTLKALSSPKPPSPALYFTGNGNGSIAKPDLTLSRHSPQGRKFYLHAWQEENEIIKFLSNGKKTSPTVINGLYPWESKSNLSRQLPDKHAKLKSAITPIKKGTVFYFHVDFDNLSEWELGLLCYALQPGKEFRHKLGMGKPIGLGSIHIEPAGLYLVHRGNRYSLDGVPDNSRYNGGIWQSEDKRLQEWQELYPRESTAAASSAAASPADFALKFSGTMTPSVQQALKRLGDPDNVVAPVHYPQVEGADLEEETYKWFVANDVGSQTKVGNRTTCTEEAARKSMLPLAGRGPLPRLKRYKWCP

SEQ ID NO: 26 - protein, 1225 aa, Desulfobulbus sp.
MAAVQDRWTLMDQQGNELKRFRITAELETASSLHIGASETVEHDLIKNDDGTPVQINALITGAGGLPIIPGSTIKGRFLARLRERGVDSALLETLFGKGHDRETEDQGRGGRAEFHDAPLCHRLSGARHFPYWRPERQIWVKAQTAVDRHRGTALRRSLRYTEMVPPGVRFRLTITGCMTDAEADVLFALLEDLGDPRQACSFGGAGADGNGTMRLFGRPEVYCLDRSGILGWLASFEKGGNGGMAMTAAALLQADTVQRRADKVRQAWQPPDVGPRLHVELRFSGPFLVNDPSRNTPDITQAPDMVPLVDEDGNPMLPASSFRGALRAQAERIIRTLGGRCCDTSSPCRPLGSSDKVGELCLACQVFGAPGWGTTLHIQGFTCTSVFRREQEQTFVAIDRFHGGCKEGALYTIRHAESPRFEGHLVIDPRMPAWGRGLLALVFRDLREGDITFGLGAGKGYGVVDAAVVQDMAELEPYVEAFREQCRQHQGMADCHSAPSPQPLRDHDLAEIPPAEEAPGETFLNPYHFVPIREPDTGSWLARDELDSSCCHSHGFYRQQVDDRPLYHGRLTCLLETETPLFIGATGDSSVPSRIENYRLGNRIAIPAASLRGMLSSLAEAASNSAMRVLHQGILSYRKKAKNALREIGMIVLRDGKRFILPLVPLMEVTKLRHAYTDPAMKHFLDDKNSWSPRCNRVYYLGRDGNQIPAETRGAGMRPGILRLLGREGRHDALQNKKHEYFIEIPERYVDQDHCFDYRMFIRDRARNGTLVPISPVAWERYHCLAEERTLSQKNDPELREDKACASLKWLPFHPKGRVRERDPENDVCHLSLRHGDLVFYAEQNRVVSEISFSAIWRSRVETSDSYQAVTVDCFVPKELRPFNRDRRAISPAELLFGFVELDESEHSTEKSRYEQMAFAGKVRLSAGLPVEDVEDSALLEPKPIVLKALSSPKPPSPPFYFVMRDGSGAYIAKKDLSPDRHRIKGRKHYLHGLRQRGNPDRVQSLDRYGHATETAANPPWETCHPEERPQIKVRVQPVRRKTKFFFHLDFSNLSRWELGLLCYVLRPTACFRHKLGMGKPLGLGSVRIDIASLQLIDRVRRYGTDDLTAGRYNMGGHFNASCLDLLPQQDSPAPDDSGAAPDPGTLRQDFVKTMDETVFRALDLLGNPAHVQRPVHYPQVREMDIEDQTFLWFVDNDKQWKDALQPLTSSSTQLPPLTRRNKR

SEQ ID NO: 27 - protein, 1234 aa, Unknown
  source: /note="Description of Unknown: Gammaproteobacteria bacterium sequence"
MTTVKEKSWAFTGLKRWKIITTLETQTPLHIGSGEVAEIEINDSQGDRRQVQANAIIRGKDDKPIIPGSTLKGKLRSHFESCLDHSKALERVFGKEYQSDEEQGRGGLAEFHDAVCSYVAPGNSYYPNWNEARNTYIEASTTIDCHTGTAADATLHYNECVPPGTRFLVTVTGAMSDKDAALIVAALQAFGDETNPIHLGAEEANGKGRMGLFGNVEVSCLDHDDIIAWISQGSDARMATDKFKPLGKEKVNDLAKNITTPTATGGAQRQHFGIELKFDGPFLVNDPSKYSKGDGDQPAVHQPLTDRSNNPILPARSFRGAIRAQAERIIRTMGGACCDTQSPCQNSGQLCIACQMFGTTGWKTTLSISDFTYDGEYRPAKTQQFVAIDRFHGGGKDGALFSIKYFERPVLKGGISLKLRNQNADELSWRKGLLALLFRDLQEGDITFGFGANKGYGGVEEACITNADVISTADIEAFRAKCHANHADSWCSPVSKPTNRDDKSSLPSINPATGAGHAFHNPYHFIPIKAPDTSTWLDKHKLATPGSPHSHAYYRSCSDDDKPLHHGRITCKLTAETPLFVGSGDAENQLTDSEAKLKEHYQLNNKLAIPATSLRGLISSLAEAASNSALRVLDNGVLSYRKPASRALRKIGILFKREEQWRLVQMEGNLANAIKLKSAYTNQKMMDFLANKQSWSPEHNVVYYLSADFRPGDVPQETYLAGRICGILRILGGKDGDRKNELENKKHELFIRVDEQYVDTEINRFDYEEYVRQGGIPVSPSAVERYTELADQRSLSQKNSRDLKGDNNCCSDKWLPFHLKGAARYKKEKACLLPLREYDLVYFDSDGTQVTEISFSAIWRDRVADKVHAFFPEELRPFNQKRKWISPAELLFGFVELNDNKDERDHAQAFTGKVRVAAGVLSPDDSIRQGDLQEHEPIMLKALSSPKLPSPALYFKQKSGDHRYIAKPDLKKASHQAQGRKIYLHALRDQKDDVQKLNTKGQPANGNGAHLPWKTADEDERPQLKVRIRPLKPGTSFYFHLDYNNLTEWELGLLCYVLQPSETFRHKLGMGKPIGLGTVKIEIATLQTIDRQKRYREAGANEHRHNGSNWVNESLRDELERLPGTVELSPDRQPEAKLRPDELRQSFIATMDNDIYRAIELLGDPHNIKYPVHYPQVRNKSIEQENFKWFVANDSGSGDQRKGTGIDAKEEPMRSIDQISTTIPTLNRYEWNGD

SEQ ID NO: 28 - protein, 1258 aa, Desulfobulbus sp.
MARNNKQYHFIPRWEIKVNLTTRSFLHIGCDEFTDRPGLEIEQKDGSKVKAEINAFIKDSNGKPYLPGSTIKGNIRKWLETNKKADEETCKLFNTLLGFTVKMQDEGCGGSAEFHNAVISSPLEDGNNFPYWDVDLQTSVETSTVIDRVTGTVVDGRLFSTEVVPPEVSFTLIITGAMTEQQVSLLTAVIKDGFAEDCPTPITIGADSGNGFGRFRFDSIHMKCLGTGEVLNWLEDGSQDMAATAMRSLSPDDIEQHIIKGRNYLKSPSVSDTVTIEFGFAGPFLVNDPSRKKRKEDIDHQPLRDSAGNARLPAKSIRGAMRSQAEKIIRTLGGWCCDPVNPCPSVFSVVEINDRLCLACRVFGATGWKSRISIQKVEYKGTAESTRQETVQDFVAIDRFHGGGKETAKFDASFSWRPQYSILMHIPSDLEGWAKGLLALTFRDFKEGDIFLGYGRSKGYGRVDSDSVKPGIDTMLTESNLELFRRKCDDNPGEYPCKTRQPPNLVQPVERNNLTEAADEGSFHNPYHFIPTPKPMIESWLAKEDFDETMHDSHALYRDVDENEEPLYHGKISCTLTTETPVFVGGKHDPRNDTEPQQVDHYTENGEIAIPATTLRGLLSSLSEAASNSSMRVLDDGMMSYRQPVGSGSLSAIGMVVIRDGKKFIYPLALPIFGERDKLPQEYHIMFPYTQKAPLKVYLERAYLAGNMKSFLDKQNSWNLLNEKIFYLPVPEFSFSRVHTMGAENRDVLKISRRGNLILGARLPVNLCPRSKEKALPGDIPGILRILGKEGRDGEVPVGKKHELFIPVSDGFASNPRSFIDNLTSKELFKIPDEVVDRFEELADDRTTQQIKHPGNVKNNNQWLPFHLKGCTRNDGLTGKDEKRLRVQEGDLMYFRPSPQSPQVAEISFSAVWRGRVNKTVHNYFPPELVQFNKNREKISPAELLFGFVQQDKHEKSLSFAGKVVLSSGKQLRETESVSRENEVTLKILASPKLPSPSLYFKRENYIEGGNYIAKNEMNNSSNIKPRGRKQYLHALSNSEDPKGVQKISRTGSVDDGGNYPWQSMNNDNIKQKVCIRPVSKDGCFTFEMEFENCTEWELGMLLYALRPSQQYRHKIGMGKSIGLGTVRIDINNLQFIHRKNRYNAGIIDVPRYNYEAGHDMDYFHNKFADTIMPEIKNSIELLGDPRNVRFPVHYPQVHGADIEDKTYQWFVANDSGTNNGQNGAAYKKNKAEESSLTELDEISNTIPGLERHEWLGR

SEQ ID NO: 29 - protein, 1235 aa, Unknown
  source: /note="Description of Unknown: Methylococcaceae bacterium sequence"
MALKTWTLNGEERWHISVVLETVTPLHIGSGEFCYRPELTNADQKPVDINACIKGANNLPIIPGSTVKGKFNAWLTARQVDTPLLEAIFGKGHNPDDDDQGSGGKVEFHDAWISTKIKDTSTWPYWQVATQTFIDAATAIDRHSRTALDASLHYTECVPPGVQFTLNITGVMQEHEAALIIAALDRFDQHDDQPYFGAGDANGQGQLILVGHLAVKVMGKTEITEWLAHFNNKASDMAMSHARSLGAEDIAGLIKLGQTLLKPVPPTVSLGIQLQFAGPFLVNDPYAVKKLEADPKTKIDHYPLLDNHKKPRLPSASIRGVLRSQAERIIRSLGVHCCDTRDPCPSLYKHQDLSQLCLACQIFGAAGWKSVINISDFTCVDANELKTQEFIAIDRFHGGGKDGAKFNAKHSERPYFQGRITLSPRMANHQLDWGKGLLALVIRDLQEGDLSFGFGANKGYGALESVLITGIDQLQTDAIEAFRRLCVTQAAPQAFITPTSAVVIGDKAPLVVTDKKLPDNSFHNPYHFIPINSPDTRHWLPTETDLAESHHSHAYYRQQPELFHGQLICRLYTETPTFIGASKKDDTLPAELDNYRLNGQLAIPATSLRGMISSLAEAASNSAMRVLDNGLLSYRKDASLALSKIGITFINRQGQWQLIPMEKIKLKNAYSAENMRLFVEQSHSWSPDYNTVYYFSEKAGAFDVPQRTPKPGWQPGILRLLGKEGRSQELENKKHEWFIPVPENYIDKQLNAFKYQEYLKDNSSKAIDIPAPVLNRYNELAYQRTLSQKKDTELVADGDSPAWLPFHLKGQQRQPQMVGKHLVYTLPMTEYSLVYYAATNKVATEISYSSIWRGRVQDDADQAATVNHFIPDDLLPFNPKRTSLSPAELLFGFTELDPDKHSNDPTRSFAGKVRIGAATLAAYPSNDSDLLAPEHITLKALSSPKLPSPALYFRTLQGNNSNVYIPKHELNPNHHTAKGRKYYLHATRTPDQKRILKLSDQGHPPQNNAVKLPWLSHQETKNLQLKVKIKPIKPKQSFYFQVDFNNLTAWELGLLCYALRPTIDFRHRIGMGKPLGLGSVKIDILALQTLDRQKRYAQDSQDSARYNQHRWVNSSVTDMLAQAGYDVIEPTANPLVPKDLKTLFSQTMAANIDRALTLLGEPQHVKQPVHYPQVRDTAIQVRDTAIEEESYQWFVANDNLSDNSSAAKQTLHDITETSEGLPTLIRHQKKKETQP

SEQ ID NO: 30 - protein, 1276 aa, Unknown
  source: /note="Description of Unknown: Gammaproteobacteria bacterium sequence"
MSDTQKQAIHENKWHFRGIKRWEISAYLKTLSPLHIGDGGTIPVTIKDTQGKNREVEVNSVITGKAALPIIPGSTIKGRLRHYFSKHFSDKALLNKVFGEESDATDDDQGRGGLAEFHDAKWNPEKNRNLQGRYPYWNNTRKTYIEVSTAINRHTGAAKDKSLHHTECVPPGTVFEIKITGSMDDRCAALVVAALEAIQTTGSRIFLGAEDANGNGRIGLTGKITVKQMDQAHIIQWLQKDSTTCVASFSNVKAENETQVKQMVQRHIAPKLNSVVSAAGPSYDITLHFDGPFVVNDSDKCKAEDTPDIYPLEEKNGVPAFPVRSFRGAIRSQAERIIRTIGGQCCDGSINNTCKNPKNLCIACEMFGSTGWKTSIEMDPFLCVDRELKPFIIQEFVAIDRFHGGGKDEAKFNAAHYQAPVFKGKVRVSQRVGNDISWRKGLLALIFRDLKEGDIYFGFGTNKGYGAVKKAEINPDGNASDFSESDIEAFINKCREKKGLYNCNPIKKPGKTKVSKNLPPAIVPLDRTDSKFYNPYHFIPVKKPNTSSWAEKTAFGTADSPHSHGFYRKQTNEQQPLYSGRLICMLTSETPFFIGAQAESDPTENENQASLRHPYQLDGEPAIPSTSLRGLISTMTEAAANCAMRVLDSEIISYRKPMNPSHILSALGMVTKRGEDFWLIPLAMPALSLNDEEHNYKLDKRYRTMFPDGLAKLKVYLEKAYSNNVMKTFLNNENTWTLAQSKIHYLPLTPIQMQNGGINSYYNNLRTPSRSNNFLIGQTVAHGNGIPASGPGAGMVPGILRILGKEHRQNDLPQNKKHELFIPVPDAFVADPKTFLDTATAFLIPRNVIDAFEKIAEKQTQSQKQDKLKHDEERLPFHLKGTRREQNHTLQIKTGDLVYFRPNAKGDEVEEIAFSSIWRGKTSGTTADFFPDKELLPFNRNRSRVSPAELLFGFTENNPKEMKIDRGLAFAGKIRISAGTLSDKFSDTTESDLFEPETTLKALSSPKPPSPALYFKEKKSGTQYIKKQDLNPGKHEIQGRKIYLHALRNENNQNVQRITSQGKFDNAANRTQPWVSQNEERNHLKTKCKPLKSGLNFFFHIDFNNLTQWELGLLCYALRPCETFRHKIGMGKPIGLGTVKIDIAVLQTIDRYARYTDTTQDSERYNQGAWISQELQNEIPNQYKGKGISNKKGMLSPEDCRKVFMETMDADIQRAIELLGDPGNVTSPVHYPQLDRKNIETKNYEWFKQNEIEQQVLKPITKNTTHLTPFARWEQG

SEQ ID NO: 31 - protein, 1221 aa, Unknown
  source: /note="Description of Unknown: Methylobacter tundripaludum sequence"
MNLPTWKLNNEKRWHISIVLTTATPLHIGSGEFCEHDDVKNNDGEPVKINACIKGSKGRPIIPGSTIKGKLYEWLKTRNTEENLLEKLFGKGHNSVSQDQGRGGKAEFHDAEIIEPLTGSQPWPYWREEHQAFIAASTAIDRHKQVALQQSLHYMETVPAGIRFKFTFTGVMRDEEAALLIAALDSFDKNQNQPCFGVDRANAYGRMELHGHLHVKVMGATEISSWLNSFSENDKKMAMESARNLEQQEINTLIKQGNALFKASCDEVKLGLTLKFKGPFLVNDPYAVKILSSNENAKTDHYPLLDKNRNPYLPVSSFRGVLRSQAERIIRTLGGKCCSTDDPCKPIFDKGDLSKLCLACQIFGASGWKTVINIHDFKAINKSKKTKQDFVAIDRFHGGGKDGAKFDATHFERPEFEGAISFSPRMANNDLDWGKGLLALVLRDMQEGDMTFGYGANKGYGGLESASITGIEQITSDIQAFRDKCVASPQTWLCDEAVKPANQQDKIPPAGIQVANSGFHNPYQFIPSKDPDTGHWLPVLGLNADSHHSHAFYRDQTDNGEKLYHGRLICCLNTETPIFIGADKKKDTEPAEINNYRLNGELAIPATSLRGMISSLAEAASNSAMRVLDNGLLSYRKTADDALRKVGMVIYVDNKSFIIKLNDAIKLKQTYTPGNMKDFIEKSNSWSPEHNTVYYLDNNQIPQESYMNGMKPGILRILGKEGREQELENKLHELFIPVPLEYVDTENNKFDYQAYKKAFLYRAIEIPEPVLKRYSELADQRTMSQKSNKELKKDDTCQSVGWLPFHLKGTKRQLDDKHKVGKLQIDEYDLIYYEASGKEVTEVAFSSIWRGRVETNSSQANKVYSFIPGELLPFNESRKKVSPAELLFGFTQINKDGSKADDKAQAFAGKVRISAGTISEYPESEANLLEQEVTLKALSTPKLPSPALYFRTINGNGSAYISKQELEPSKHLAKGRKYYLHALRTGDNKVQKLGSQGETANGGDSKLPWVTHNPDERPQLKVKIKPIKAEFIFSLDFNNLTEWELGLLCYALRPTDSFRHRIGMGKPLGLGSVKIDIMALQTINRQQRYAQDGLEENRFNRHNWVNPPHQPRLDKAGYSISLSSTPLNPEILRATFTKTMNADIYRTLELLGNPQNVKRPVHYPQVENHNIEQENYKWFVANDQGSGKGRNKIDPAEKALKILTENSDCLPTLSRLDWRDE

SEQ ID NO: 32 - protein, 1444 aa, Nitrosomonas sp.
MNNKGSNMTDTVKSGRWIITGQFQLVTPMHIGTGLDEEMDKQSGESVDKKQNNSWIQAIALDLNKKPYIPGASIKGALKALARRYYCASNLNIFGDTIDTKDGDNKRKSVTVAGQAEFLNAWYAADQEDKPFDTITRVAIDRVTGTAEDRKLFNTRRVNPGVCFNYKIIIQNACETEIQYLLDLLRKAAKDPSFSLGAGANQSQGKVRCLSSCVRYFGKQEMHDWFRAIQNGKQEHWQIFAKPSNIKYADLERPDIIANSLNLPLTLDFHTPFLVKASKKKDEAKNEADAKPRTNHQGQVILPASSLRGRLRAQAEKILRTMGQDIPQGHAAPAYDGIAHRDLISLLFGTAGWKGIVCASDLIHSIPEYALQFNGVRETISDLSDTVKSCIIVDLVKTSTAAEKTEEQLHIRIVDSAGSLIVHKSENSSWANDTFRDASVKDNFKARLKEIADPQDLSDALRADIKKRAFQLATLTRHEMVAIDRFTGGGKEGAKFNVDYIECPTLTGAIYLDLHRLKQAQLKNDEDALKPALGLISLLLRDLAEGDIAFGFGANKGYGQCREHAVLDNWEERLKKIGAGLTIDGALQALRDTVALEPPAEFPPEIEKTTDDNQPEAPDFNLKPASNGFHNPYHFIPLNNPKIGDWPEAKAETLKANREGHDQYHTGKFSGRIVCSLTTQTPLFIGAETKPSTSDREPSEARPFKLNGKHAIPATSLRGMLSSLFESVSNSNFRVLHPEHYSVRKSLDDYVALSAMGRIVDDQGELKLQPLTLPTLFGNRNNVPAKWEKIFGTPSEDDFLRIYFDDIPSKFSSNKRYFYNCKATELKDFIKSDKYFIGKRTPTVFPKSSTEKSHLESLEFIDVEKFKKAVENLEITPGNNPYIHGWVRNLKDEFREDIPDNVKHHVFLPDTTKRVSPLEIPPHVKKRFHELADLALAGLHLKQGETIASPYKILPYTPIGRNKLENHIHRVPNDLTCYMTRLKKGDLVFFDVDNDGQITEISFSSIWRAGIGTKNKLQTTADLLSQRDPNLVQLGMGVRTKNTDRFKLSPAERLFGVVEHRDDDNTTVENVNQPNDKAQAFAFAGKVRIGFGLPDKKTTVNGVSPVTLKELSSPKPPSPAFYLKRKNNDDFVSKKVAAECSETMTLRGRKCYLHAWREQNGNVMKLDAIGVNSGGSTCKPPWKTHKPAANDQKEFEEDKNKFITSRQVKIAPISENTPFYFEIDFNNLDATELAQLCATLQPAPKFEHRLGMGKPLGLGSVKIEPVGLFLINRHQRYTTDSTNCDRYHYAWLKGEHAAWDWPEYFRQNVVTADCTQTFNDTFDKLVQNGLAGTDADIKHALQLLGDPQYIGVPVHYPIAGNSTLENKHFEWFGNNDKASVLRQKAQANSKNHHYQPKQQATPEEPQYLHTITKDSKQISLLKKNKIEDIENRDQQKHRYSNHRR

SEQ ID NO: 33 - protein, 385 aa, Artificial Sequence
  source: /note="Description of Artificial Sequence: Synthetic polypeptide"
QLHLPQVLADAVSRLVLGKFGDLTDNFSSPHARRKVLAGVVMTTGTDVKDAKVISVSTGTKCINGEYMSDRGLALNDCHAEIISRRSLLRFLYTQLELYLNNKDDQKRSIFQKSERGGFRLKENVQFHLYISTSPCGDARIFSPHEPILEEPADRHPNRKARGQLRTKIESGQGTIPVRSNASIQTWDGVLQGERLLTMSCSDKIARWNVVGIQGSLLSIFVEPIYFSSIILGSLYHGDHLSRAMYQRISNIEDLPPLYTLNKPLLSGISNAEARQPGKAPNFSVNWTVGDSAIEVINATTGKDELGRASRLCKHALYCRWMRVHGKVPSHLLRSKITKPNVYHESKLAAKEYQAAKARLFTAFIKAGLGAWVEKPTEQDQFSLT

SEQ ID NO: 34 - protein, 336 aa, Artificial Sequence
  source: /note="Description of Artificial Sequence: Synthetic polypeptide"
SLGTGNRCVKGDSLSLKGETVNDCHAEIISRRGFIRFLYSELMKYNSQTAKDSIFEPAKGGEKLQIKKTVSFHLYISTAPCGDGALFDKSCSDRAMESTESRHYPVFENPKQGKLRTKVENGQGTIPVESSDIVPTWDGIRLGERLRTMSCSDKILRWNVLGLQGALLTHFLQPIYLKSVTLGYLFSQGHLTRAICCRVTRDGSAFEDGLRHPFIVNHPKVGRVSIYDSKRQSGKTKETSVNWCLADGYDLEILDGTRGTVDGPRNELSRVSKKNIFLLFKKLCSFRYRRDLLRLSYGEAKKAARDYETAKNYFKKGLKDMGYGNWISKPQEEKNF

SEQ ID NO: 35 - protein, 340 aa, Artificial Sequence
  source: /note="Description of Artificial Sequence: Synthetic polypeptide"
SVGTGNRCLTGDHLSLEGNSVNDSHAEMITRRGFLRYLYRHLLEYDAEVPNDLFEKGERSICRIKTNITFHLYISTAPCGDGALFSPRDTDSSNAKMEEENKHIHNPTFSSSVQGLLRTKVEGGQGTIPIDADFTEQTWDGIQRGERLRTMSCSDKICRWNVVGLQGALLSHFIEPIYLDSLTLGYLYDHGHLARAVCCRIERGEASVNQLLPEGYRLNHPWLGRVTACDPPRETQKTKSLSINWCYDDEKSEVLDGTAGICYTAIEKNLFSRLTKHNLYEEFKRVCRKFDRNDLLTAPSYNKAKMMATPFQTAKNVMLKKLKENNCGTWVSKPIEEEMF

SEQ ID NO: 36 - protein, 340 aa, Artificial Sequence
  source: /note="Description of Artificial Sequence: Synthetic polypeptide"
SVGTGNRCLTGDRLSLEGNSVNDSHAEMVTRRGFLRYLYKHLLEYDPEKPHDLFEKGERSLCRIKTNITFHLYISTAPCGDGALFSPRDTDSSNVKVDEENKHVHNPTFSSSVQGLLRTKVEGGQGTIPIDADFTEQTWDGIQRGERLRTMSCSDKICRWNVVGLQGALLSHFVEPIYLESLTLGYLYDHGHLARAVCCRIERGEASVNQLLPEGYRLNHPWLGRVTACDPPRETQKTKSLSINWCYDDEKSEVLDGTAGICYTAIEKNLFSRLTKHSLYEEFKKVCQKFEREDLLNVTSYNKAKMMAIPFQTAKNVMLKKLKENNCGTWVSKPIEEEMF

SEQ ID NO: 37 - protein, 328 aa, Artificial Sequence
  source: /note="Description of Artificial Sequence: Synthetic polypeptide"
GIGTGTKCINGEHMSDRGFGVNDCHAEIIARRCFLRYIYDQLELHLSDNSDVRNSSIFELRDKGGYQLKENIQFHLYISTAPCGDARIFSPHGQDVETGDRHPNRKARGQLRTKIESGQGTIPVRTSGVIQTWDGVLEGERLLTMSCSDKIARWNVLGIQGSLLSHFMNPIYLESIILGSLYHSDHLSRAMYSRISIIENLPEPFHLNRPFLSGISSPESRQPGKAPNFGINWRKEDETFEVINAMTGRVEGGSVSRICKQALFGRFMSLYGKLSSLTGQSVTTRPTHYSDAKAAVMEYQLAKQCVFQAFQKAGLGNWVQKPIEQDQF

SEQ ID NO: 38 - protein, 328 aa, Artificial Sequence
  source: /note="Description of Artificial Sequence: Synthetic polypeptide"
GIGTGTKCINGEYMNDRGFAVNDCHAEIIARRCFLRFIYDQLEMHLSEDPEVRGQSVFELRDGGGYKLKPNIHFHLYISTAPCGDARIFSPHGQDVETGDRHPNRKARGQLRTKIESGQGTIPVRSSGFIQTWDGVLEGERLLTMSCSDKIARWNVLGIQGALLCHFMHPIYLESIILGSLYHSDHLSRAVYCRIASIENLPDLFQLNRPFLSGISSPESRQPGKAPNFGINWRRNDDTFEVINAMTGRVEGGNMSRICKQALFDRFMNLYGRLSSLTGQSVTTRPTLYSEAKAAVMEYQLAKQCVFQAFQKAGLGNWVQKPIEQDQF

SEQ ID NO: 39 - protein, 328 aa, Artificial Sequence
  source: /note="Description of Artificial Sequence: Synthetic polypeptide"
GIGTGTKCINGEYMNDRGFAVNDCHAEIIARRCFLRFIYDQLELHLSDNAEVRGQSIFELRDAGGYKLKPNIQFHLYISTAPCGDARIFSPHGQDVETGDRHPNRKARGQLRTKIESGQGTIPVRSSGFIQTWDGVLEGERLLTMSCSDKIARWNVLGVQGALLCHFMHPIYLESIILGSLYHSDHLSRAVYCRIAAIENLPDLFRLNRPFLSGISSPESRQPGKAPNFGINWRRNDDSFEVINAMTGRVEGGSMSRICKQALFDRFMNLYGKLSSLTGQSVTTRPALYSEAKATVMEYQLAKQCVFQAFQKAGLGNWVQKPIEQDQF

SEQ ID NO: 40 - protein, 236 aa, Unknown
  source: /note="Description of Unknown: APOBEC1  sequence"
MTSEKGPSTGDPTLRRRIEPWEFDVFYDPRELRKEACLLYEIKWGMSRKIWRSSGKNTTNHVEVNFIKKFTSERDFHPSMSCSITWFLSWSPCWECSQAIREFLSRHPGVTLVIYVARLFWHMDQQNRQGLRDLVNSGVTIQIMRASEYYHCWRNFVNYPPGDEAHWPQYPPLWMMLYALELHCIILSLPPCLKISRRWQNHLTFFRLHLQNCHYQTIPPHILLATGLIHPSVAWR

SEQ ID NO: 41 - protein, 224 aa, Unknown
  source: /note="Description of Unknown: APOBEC2  sequence"
MAQKEEAAVATEAASQNGEDLENLDDPEKLKELIELPPFEIVTGERLPANFFKFQFRNVEYSSGRNKTFLCYVVEAQGKGGQVQASRGYLEDEHAAAHAEEAFFNTILPAFDPALRYNVTWYVSSSPCAACADRIIKTLSKTKNLRLLILVGRLFMWEEPEIQAALKKLKEAGCKLRIMKPQDFEYVWQNFVEQEEGESKAFQPWEDIQENFLYYEEKLADILK

SEQ ID NO: 42 - protein, 199 aa, Unknown
  source: /note="Description of Unknown: APOBEC3A  sequence"
MEASPASGPRHLMDPHIFTSNFNNGIGRHKTYLCYEVERLDNGTSVKMDQHRGFLHNQAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFKHCWDTFVDHQGCPFQPWDGLDEHSQALSGRLRAILQNQGN

SEQ ID NO: 43 - protein, 251 aa, Unknown [sequence omitted]

SEQ ID NO: 44 - protein, 190 aa, Unknown
  source: /note="Description of Unknown: APOBEC3C  sequence"
MNPQIRNPMKAMYPGTFYFQFKNLWEANDRNETWLCFTVEGIKRRSVVSWKTGVFRNQVDSETHCHAERCFLSWFCDDILSPNTKYQVTWYTSWSPCPDCAGEVAEFLARHSNVNLTIFTARLYYFQYPCYQEGLRSLSQEGVAVEIMDYEDFKYCWENFVYNDNEPFKPWKGLKTNFRLLKRRLRESLQ

SEQ ID NO: 45 - protein, 455 aa, Unknown
  source: /note="Description of Unknown: APOBEC3D  sequence"
MNPQIRNPMERMYRDTFYDNFENEPILYGRSYTWLCYEVKIKRGRSNLLWDTGVFRGPVLPKRQSNHRQEVYFRFENHAEMCFLSWFCGNRLPANRRFQITWFVSWNPCLPCVVKVTKFLAEHPNVTLTISAARLYYYRDRDWRWVLLRLHKAGARVKIMDYEGERCRGQGSMTGRNSLRDGWICNAMAGGVPGQPAGVGLALIATDSQETRPGRAGPGSGESLSASHLFISDFAYCWENFVCNEGQPFMPWYKFDDNYASLHRTLKEILRNPMEAMYPHIFYFHFKNLLKACGRNESWLCFTMEVTKHHSAVFRKRGVFRNQVDPETHCHAERCFLSWFCDDILSPNTNYEVTWYTSWSPCPECAGEVAEFLARHSNVNLTIFTARLCYFWDTDYQEGLCSLSQEGASVKIMGYKDFVSCWKNFVYSDDEPFKPWKGLQTNFRLLKRRLREILQ

SEQ ID NO: 46 - protein, 373 aa, Unknown
  source: /note="Description of Unknown: APOBEC3F  sequence"
MKPHFRNTVERMYRDTFSYNFYNRPILSRRNTVWLCYEVKTKGPSRPRLDAKIFRGQVYSQPEHHAEMCFLSWFCGNQLPAYKCFQITWFVSWTPCPDCVAKLAEFLAEHPNVTLTISAARLYYYWERDYRRALCRLSQAGARVKIMDDEEFAYCWENFVYSEGQPFMPWYKFDDNYAFLHRTLKEILRNPMEAMYPHIFYFHFKNLRKAYGRNESWLCFTMEVVKHHSPVSWKRGVFRNQVDPETHCHAERCFLSWFCDDILSPNTNYEVTWYTSWSPCPECAGEVAEFLARHSNVNLTIFTARLYYFWDTDYQEGLRSLSQEGASVEIMGYKDFKYCWENFVYNDDEPFKPWKGLKYNFLFLDSKLQEILE

SEQ ID NO: 47 - protein, 325 aa, Unknown
  source: /note="Description of Unknown: APOBEC3G  sequence"
MELKYHPEMRFFHWFSKWRKLHRDQEYEVTWYISWSPCTKCTRDMATFLAEDPKVTLTIFVARLYYFWDPDYQEALRSLCQKRDGPRATMKIMNYDEFQHCWSKFVYSQRELFEPWNNLPKYYILLHIMLGEILRHSMDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYDDQGRCQEGLRTLAEAGAKISIMTYSEFKHCWDTFVDHQGCPFQPWDGLDEHSQDLSGRLRAILQNQEN

SEQ ID NO: 48 - protein, 154 aa, Unknown [sequence omitted]

SEQ ID NO: 49 - protein, 367 aa, Unknown
  source: /note="Description of Unknown: APOBEC4  sequence"
MEPIYEEYLANHGTIVKPYYWLSFSLDCSNCPYHIRTGEEARVSLTEFCQIFGFPYGTTFPQTKHLTFYELKTSSGSLVQKGHASSCTGNYIHPESMLFEMNGYLDSAIYNNDSIRHIILYSNNSPCNEANHCCISKMYNFLITYPGITLSIYFSQLYHTEMDFPASAWNREALRSLASLWPRVVLSPISGGIWHSVLHSFISGVSGSHVFQPILTGRALADRHNAYEINAITGVKPYFTDVLLQTKRNPNTKAQEALESYPLNNAFPGQFFQMPSGQLQPNLPPDLRAPVVFVLVPLRDLPPMHMGQNPNKPRNIVRHLNMPQMSFQETKDLGRLPTGRSVEIVEITEQFASSKEADEKKKKKGKK

SEQ ID NO: 50 - protein, 180 aa, Unknown
  source: /note="Description of Unknown: Activation-induced cytidine deaminase (AID)  sequence"
MDSLLMNRKFLYQFKNVRWAKGRRETYLCYVVKRRDSATSFSLDFGYLRNKNGCHVELLFLRYISDWDLDPGRCYRVTWFTSWSPCYDCARHVADFLRGNPNLSLRIFTARLYFCEDRKAEPEGLRRLHRAGVQIAIMTFKDYFYCWNTFVENHERTFKAWEGLHENSVRLSRQLRRILL

SEQ ID NO: 51 - DNA, 31 bp, Artificial Sequence
  source: /note="Description of Artificial Sequence: Synthetic oligonucleotide"
ctttgttgtcttcgacatgggtaatcctcat

SEQ ID NO: 52 - DNA, 31 bp, Artificial Sequence
  source: /note="Description of Artificial Sequence: Synthetic oligonucleotide"
taaagagttgaacttctttgttgtcttcgac

SEQ ID NO: 53 - DNA, 31 bp, Artificial Sequence
  source: /note="Description of Artificial Sequence: Synthetic oligonucleotide"
gtaccttcgtacggacgaccttcaccttcac

SEQ ID NO: 54 - DNA, 31 bp, Artificial Sequence
  source: /note="Description of Artificial Sequence: Synthetic oligonucleotide"
caggatgtcccaagcgaacggcagcggacca

SEQ ID NO: 55 - DNA, 31 bp, Artificial Sequence
  source: /note="Description of Artificial Sequence: Synthetic oligonucleotide"
cagggaggagtcctgggtaacggtaacaaca

SEQ ID NO: 56 - DNA, 31 bp, Artificial Sequence
  source: /note="Description of Artificial Sequence: Synthetic oligonucleotide"
catgaactctttgataacgtcttcgctactc

SEQ ID NO: 57 - DNA, 31 bp, Artificial Sequence
  source: /note="Description of Artificial Sequence: Synthetic oligonucleotide"
tcggaggtagcccgactcgctccggttcgta

SEQ ID NO: 58 - DNA, 31 bp, Artificial Sequence
  source: /note="Description of Artificial Sequence: Synthetic oligonucleotide"
tgaaagttggcgccttttttcatacgtcgag

SEQ ID NO: 59 - RNA, 300 nt, Artificial Sequence
  source: /note="Description of Artificial Sequence: Synthetic polynucleotide"
gggcgaaaucgguauuuccaaugaaaucacucagguuggaaagccgguuuucuuugaugucacggaaccgccaauauaacaauacagguauuauaguuggguuggaaagccgguuuucuuugaugucacggaacauuguaaacugcauaucuguguuugccgucugguuggaaagccgguuuucuuugaugucacggaacucacgugagucagucuuaguucuauacuucuuuaggguuggaaagccgguuuucuuugaugucacggaacaggaacuugaacaacaucguuacuaacgag

SEQ ID NO: 60 - RNA, 176 nt, Artificial Sequence
  source: /note="Description of Artificial Sequence: Synthetic polynucleotide"
gggggccagugaauucgagcucgguacccggggauccucuagaaauauggauuacuugguagaacagcaaucuacucgaccugcaggcaugcaagcuuggcguaaucauggucauagcuguuuccuguguuuauccgcucacaauuccacacaacauacgagccggaagcauaaag

SEQ ID NO: 61 - RNA, 153 nt, Artificial Sequence
  source: /note="Description of Artificial Sequence: Synthetic polynucleotide"
ggggcaaacuccggcaucuacuaauagacgccggccauucaaacaugaggauuacccaugucgaagacaacaaagaaguucaacucuuuauguauugaucuuccucgcgaucuuucucucgaaauuuaccaaucaauugcuucugucgcuacu

SEQ ID NO: 62 - RNA, 153 nt, Artificial Sequence
  source: /note="Description of Artificial Sequence: Synthetic polynucleotide"
gggggccagugaauucgagcucgguacccggggauccucuagaaauauggauuacuugguagaacagcaaucuacucgaccugcaggcaugcaagcuuggcguaaucauggucauagcuguuuccuguguuuauccgcucacaauuccacaca

SEQ ID NO: 63 - RNA, 150 nt, Artificial Sequence
  source: /note="Description of Artificial Sequence: Synthetic polynucleotide"
ggccagugaauucgagcucgguacccggggauccucuagaaauauggauuacuugggucgaagacaacaaagaaguucaacucuuuauagaacagcaaucuacucgaccugcaggcaugcaagcuuggcguaaucauggucauagcuguu

SEQ ID NO: 64 - RNA, 150 nt, Artificial Sequence
  source: /note="Description of Artificial Sequence: Synthetic polynucleotide"
augcccgccaugaagaucgagugccgcaucaccggcacccugaacggcguggaguugucgaagacaacaaagaaguucaacucuuuacgagcuggugggcggcggagagggcacccccgagcagggccgcaugaccaacaagaugaagag

SEQ ID NO: 65 - RNA, 150 nt, Artificial Sequence
  source: /note="Description of Artificial Sequence: Synthetic polynucleotide"
auucuaugucugguuuucgcucaaaaacuucccggaaaugacaacagcacggcaacgucgaagacaacaaagaaguucaacucuuuagcugugccuugggcaccaugcaguaccaaacggaacgauagugaaaacaaucacgaaugacca

SEQ ID NO: 66 - RNA, 150 nt, Artificial Sequence; identical to SEQ ID NO: 65
  source: /note="Description of Artificial Sequence: Synthetic polynucleotide"

SEQ ID NO: 67 - RNA, 150 nt, Artificial Sequence
  source: /note="Description of Artificial Sequence: Synthetic polynucleotide"
gcugugccuugggcaccaugcaguaccaaacggaacgauagugaaaacaaucacgaaugaccagucgaagacaacaaagaaguucaacucuuuaauucuaugucugguuuucgcucaaaaacuucccggaaaugacaacagcacggcaac

SEQ ID NO: 68 - RNA, 173 nt, Artificial Sequence
  source: /note="Description of Artificial Sequence: Synthetic polynucleotide"
gggguuuggaagccgggucgaagucaggcccguuaagaccgaguagauugcuguucuaccaaguaauccaguuuggaagccgggucgaagucaggcccguuaagacuaugcuuccggcucguauguuguguggaauuguuuggaagccgggucgaagucaggcccguuaagac

SEQ ID NO: 69 - RNA, 259 nt, Artificial Sequence
  source: /note="Description of Artificial Sequence: Synthetic polynucleotide"
ggggcuagcucaguccuagguauaaugcuagcgcugauuuaggcaaaaacggcuugaagacuaaaggaaggaauuaaugucacgguacgacuaaauggcaccacuaauuguugccuucuaaguuccuucuugaagacuaaaggaaggaauuaaugucacgguacguuuguuuaaccacaugaggcacaccgcccucgugagcuugaagacuaaaggaaggaauuaaugucacgguacaaucuccgccccguucguaagc

SEQ ID NO: 70 - RNA, 400 nt, Artificial Sequence
  source: /note="Description of Artificial Sequence: Synthetic polynucleotide"
augcccgccaugaagaucgagugccgcaucaccggcacccugaacggcguggaguucgagcuggugggcggcggagagggcacccccgagcagggccgcaugaccaacaagaugaagagcaccaaaggcgcccugaccuucagccccuaccugcugagccacgugaugggcuacggcuucuaccacuucggcaccuaccccagcggcuacgagaaccccuuccugcacgccaucaacaacggcggcuacaccaacacccgcaucgagaaguacgaggacggcggcgugcugcacgugagcuucagcuaccgcuacgaggccggccgcgugaucggcgacuucaagguggugggcaccggcuuccccgaggacagcgugaucuucaccgacaagaucaucc

SEQ ID NO: 71 - RNA, 103 nt, Artificial Sequence
  source: /note="Description of Artificial Sequence: Synthetic polynucleotide"
gggguuggaaagccgguuuucuuugaugucacggaaccuuuguugucuucgacauggguaauccucaugguuggaaagccgguuuucuuugaugucacggaac

SEQ ID NO: 72 - RNA, 103 nt, Artificial Sequence
  source: /note="Description of Artificial Sequence: Synthetic polynucleotide"
ggcguuggaaagccgguuuucuuugaugucacggaaccuuuguugucuucgacauggguaauccucaucguuggaaagccgguuuucuuugaugucacggaac

SEQ ID NO: 73 - RNA, 103 nt, Artificial Sequence
  source: /note="Description of Artificial Sequence: Synthetic polynucleotide"
ggggauggaaagccgguuuucuuugaugucacggaaccuuuguugucuucgacauggguaauccucauggauggaaagccgguuuucuuugaugucacggaac

SEQ ID NO: 74 - RNA, 103 nt, Artificial Sequence
  source: /note="Description of Artificial Sequence: Synthetic polynucleotide"
gggguucgaaagccgguuuucuuugaugucacggaaccuuuguugucuucgacauggguaauccucaugguucgaaagccgguuuucuuugaugucacggaac

SEQ ID NO: 75 - RNA, 103 nt, Artificial Sequence
  source: /note="Description of Artificial Sequence: Synthetic polynucleotide"
gggguugguaagccgguuuucuuugaugucacggaaccuuuguugucuucgacauggguaauccucaugguugguaagccgguuuucuuugaugucacggaac

SEQ ID NO: 76 - RNA, 103 nt, Artificial Sequence
  source: /note="Description of Artificial Sequence: Synthetic polynucleotide"
gggguuggaaugccgguuuucuuugaugucacggaaccuuuguugucuucgacauggguaauccucaugguuggaaugccgguuuucuuugaugucacggaac

SEQ ID NO: 77 - RNA, 103 nt, Artificial Sequence
  source: /note="Description of Artificial Sequence: Synthetic polynucleotide"
gggguuggaaaggcgguuuucuuugaugucacggaaccuuuguugucuucgacauggguaauccucaugguuggaaaggcgguuuucuuugaugucacggaac

SEQ ID NO: 78 - RNA, 103 nt, Artificial Sequence
  source: /note="Description of Artificial Sequence: Synthetic polynucleotide"
gggguuggaaagcccguuuucuuugaugucacggaaccuuuguugucuucgacauggguaauccucaugguuggaaagcccguuuucuuugaugucacggaac

SEQ ID NO: 79 - RNA, 103 nt, Artificial Sequence
  source: /note="Description of Artificial Sequence: Synthetic polynucleotide"
gggguuggaaagccggauuucuuugaugucacggaaccuuuguugucuucgacauggguaauccucaugguuggaaagccggauuucuuugaugucacggaac

SEQ ID NO: 80 - RNA, 103 nt, Artificial Sequence
  source: /note="Description of Artificial Sequence: Synthetic polynucleotide"
gggguuggaaagccgguuaucuuugaugucacggaaccuuuguugucuucgacauggguaauccucaugguuggaaagccgguuaucuuugaugucacggaac

SEQ ID NO: 81 - RNA, 103 nt, Artificial Sequence
  source: /note="Description of Artificial Sequence: Synthetic polynucleotide"
gggguuggaaagccgguuuuguuugaugucacggaaccuuuguugucuucgacauggguaauccucaugguuggaaagccgguuuuguuugaugucacggaac

SEQ ID NO: 82 - RNA, 103 nt, Artificial Sequence
  source: /note="Description of Artificial Sequence: Synthetic polynucleotide"
gggguuggaaagccgguuuucuaugaugucacggaaccuuuguugucuucgacauggguaauccucaugguuggaaagccgguuuucuaugaugucacggaac

SEQ ID NO: 83 - RNA, 103 nt, Artificial Sequence
  source: /note="Description of Artificial Sequence: Synthetic polynucleotide"
gggguuggaaagccgguuuucuuucaugucacggaaccuuuguugucuucgacauggguaauccucaugguuggaaagccgguuuucuuucaugucacggaac

SEQ ID NO: 84 - RNA, 103 nt, Artificial Sequence
  source: /note="Description of Artificial Sequence: Synthetic polynucleotide"
gggguuggaaagccgguuuucuuugaagucacggaaccuuuguugucuucgacauggguaauccucaugguuggaaagccgguuuucuuugaagucacggaac

SEQ ID NO: 85 - RNA, 103 nt, Artificial Sequence
  source: /note="Description of Artificial Sequence: Synthetic polynucleotide"
gggguuggaaagccgguuuucuuugaugacacggaaccuuuguugucuucgacauggguaauccucaugguuggaaagccgguuuucuuugaugacacggaac

SEQ ID NO: 86 - RNA, 103 nt, Artificial Sequence
  source: /note="Description of Artificial Sequence: Synthetic polynucleotide"
gggguuggaaagccgguuuucuuugaugucucggaaccuuuguugucuucgacauggguaauccucaugguuggaaagccgguuuucuuugaugucucggaac

SEQ ID NO: 87 - RNA, 103 nt, Artificial Sequence
  source: /note="Description of Artificial Sequence: Synthetic polynucleotide"
gggguuggaaagccgguuuucuuugaugucaccgaaccuuuguugucuucgacauggguaauccucaugguuggaaagccgguuuucuuugaugucaccgaac

SEQ ID NO: 88 - RNA, 103 nt, Artificial Sequence
  source: /note="Description of Artificial Sequence: Synthetic polynucleotide"
gggguuggaaagccgguuuucuuugaugucacgguaccuuuguugucuucgacauggguaauccucaugguuggaaagccgguuuucuuugaugucacgguac

SEQ ID NO: 89 - RNA, 103 nt, Artificial Sequence
  source: /note="Description of Artificial Sequence: Synthetic polynucleotide"
gggguuggaaagccgguuuucuuugaugucacgguagcuuuguugucuucgacauggguaauccucaugguuggaaagccgguuuucuuugaugucacgguag

SEQ ID NO: 90 - RNA, 103 nt, Artificial Sequence; identical to SEQ ID NO: 71
  source: /note="Description of Artificial Sequence: Synthetic polynucleotide"

SEQ ID NO: 91 - RNA, 103 nt, Artificial Sequence
  source: /note="Description of Artificial Sequence: Synthetic polynucleotide"
gggguuggaaaggggguuuucuuugaugucacggaaccuuuguugucuucgacauggguaauccucaugguuggaaaggggguuuucuuugaugucacggaac

SEQ ID NO: 92 - RNA, 103 nt, Artificial Sequence
  source: /note="Description of Artificial Sequence: Synthetic polynucleotide"
gggguuggaaagccgcauuucuuugaugucacggaaccuuuguugucuucgacauggguaauccucaugguuggaaagccgcauuucuuugaugucacggaac

SEQ ID NO: 93 - RNA, 103 nt, Artificial Sequence
  source: /note="Description of Artificial Sequence: Synthetic polynucleotide"
gggguuggaaagccgguuaacuuugaugucacggaaccuuuguugucuucgacauggguaauccucaugguuggaaagccgguuaacuuugaugucacggaac

SEQ ID NO: 94 - RNA, 103 nt, Artificial Sequence
  source: /note="Description of Artificial Sequence: Synthetic polynucleotide"
gggguuggaaagccgguuuugauugaugucacggaaccuuuguugucuucgacauggguaauccucaugguuggaaagccgguuuugauugaugucacggaac

SEQ ID NO: 95 - RNA, 103 nt, Artificial Sequence
  source: /note="Description of Artificial Sequence: Synthetic polynucleotide"
gggguuggaaagccgguuuucuuacaugucacggaaccuuuguugucuucgacauggguaauccucaugguuggaaagccgguuuucuuacaugucacggaac

SEQ ID NO: 96 - RNA, 103 nt, Artificial Sequence
  source: /note="Description of Artificial Sequence: Synthetic polynucleotide"
gggguuggaaagccgguuuucuuugaacucacggaaccuuuguugucuucgacauggguaauccucaugguuggaaagccgguuuucuuugaacucacggaac

SEQ ID NO: 97 - RNA, 103 nt, Artificial Sequence
  source: /note="Description of Artificial Sequence: Synthetic polynucleotide"
gggguuggaaagccgguuuucuuugaugugucggaaccuuuguugucuucgacauggguaauccucaugguuggaaagccgguuuucuuugaugugucggaac

SEQ ID NO: 98 - RNA, 103 nt, Artificial Sequence
  source: /note="Description of Artificial Sequence: Synthetic polynucleotide"
gggguuggaaagccgguuuucuuugaugucacccaaccuuuguugucuucgacauggguaauccucaugguuggaaagccgguuuucuuugaugucacccaac

SEQ ID NO: 99 - RNA, 103 nt, Artificial Sequence
  source: /note="Description of Artificial Sequence: Synthetic polynucleotide"
gggguuggaaagccgguuuucuuugaugucacggaugcuuuguugucuucgacauggguaauccucaugguuggaaagccgguuuucuuugaugucacggaug

SEQ ID NO: 100 - RNA, 153 nt, Artificial Sequence
  source: /note="Description of Artificial Sequence: Synthetic polynucleotide"
gggaaaucagcgaaaugcaccccgcauuacguuugguggacccucagauucaacuggcaguaaccagaauggagaacgcaguggggcgcgaucaaaacaacgucggccccaagguuuacccaauaauacugcgucuugguucaccgcucucac

SEQ ID NO: 101 - RNA, 153 nt, Artificial Sequence
  source: /note="Description of Artificial Sequence: Synthetic polynucleotide"
gggauucuaugucugguuuucgcucaaaaacuucccggaaaugacaacagcacggcaacgcugugccuugggcaccaugcaguaccaaacggaacgauagugaaaacaaucacgaaugaccaaauugaagucacuaaugcuacugaacugguu

SEQ ID NO: 102 - DNA, 34 bp, Artificial Sequence
  source: /note="Description of Artificial Sequence: Synthetic oligonucleotide"
gggatgaggattacccatgtcgaagacaacaaag

SEQ ID NO: 103 - RNA, 100 nt, Artificial Sequence
  source: /note="Description of Artificial Sequence: Synthetic polynucleotide"
augcccgccaugaagaucgagugccgcaucaccggcacccugaacggcguggaguucgagcuggugggcggcggagagggcacccccgagcagggccgca

SEQ ID NO: 104 - RNA, 200 nt, Artificial Sequence
  source: /note="Description of Artificial Sequence: Synthetic polynucleotide"
augcccgccaugaagaucgagugccgcaucaccggcacccugaacggcguggaguucgagcuggugggcggcggagagggcacccccgagcagggccgcaugaccaacaagaugaagagcaccaaaggcgcccugaccuucagccccuaccugcugagccacgugaugggcuacggcuucuaccacuucggcaccuaccc

SEQ ID NO: 105 - RNA, 600 nt, Artificial Sequence
  source: /note="Description of Artificial Sequence: Synthetic polynucleotide"
augcccgccaugaagaucgagugccgcaucaccggcacccugaacggcguggaguucgagcuggugggcggcggagagggcacccccgagcagggccgcaugaccaacaagaugaagagcaccaaaggcgcccugaccuucagccccuaccugcugagccacgugaugggcuacggcuucuaccacuucggcaccuaccccagcggcuacgagaaccccuuccugcacgccaucaacaacggcggcuacaccaacacccgcaucgagaaguacgaggacggcggcgugcugcacgugagcuucagcuaccgcuacgaggccggccgcgugaucggcgacuucaagguggugggcaccggcuuccccgaggacagcgugaucuucaccgacaagaucauccgcagcaacgccaccguggagcaccugcaccccaugggcgauaacgugcuggugggcagcuucgcccgcaccuucagccugcgcgacggcggcuacuacagcuucgugguggacagccacaugcacuucaagagcgccauccaccccagcauccugcagaacgggggccccauguucgccuuccgccgcguggaggagcug

SEQ ID NO: 106 - RNA, 60 nt, Artificial Sequence
  source: /note="Description of Artificial Sequence: Synthetic oligonucleotide"
ccggccauucaaacaugaggauuacccaugucgaagacaacaaagaaguucaacucuuua

SEQ ID NO: 107 - RNA, 175 nt, Artificial Sequence
  source: /note="Description of Artificial Sequence: Synthetic polynucleotide"
  modified_base (76)..(81): a, c, u, g, unknown or other
ggccagugaauucgagcucgguacccggggauccucuagaaauauggauuacuugguagaacagcaaucuacucgnnnnnnaccugcaggcaugcaagcuuggcguaaucauggucauagcuguuuccuguguuuauccgcucacaauuccacacaacauacgagccggaagcau

SEQ ID NO: 108 - RNA, 175 nt, Artificial Sequence
  source: /note="Description of Artificial Sequence: Synthetic polynucleotide"
  modified_base (45)..(50): a, c, u, g, unknown or other
ggccagugaauucgagcucgguacccggggauccucuagaaauannnnnnuggauuacuugguagaacagcaaucuacucgaccugcaggcaugcaagcuuggcguaaucauggucauagcuguuuccuguguuuauccgcucacaauuccacacaacauacgagccggaagcau

SEQ ID NO: 109 - RNA, 34 nt, Artificial Sequence
  source: /note="Description of Artificial Sequence: Synthetic oligonucleotide"
gggaugaggauuacccaugucgaagacaacaaag

SEQ ID NO: 110 - DNA, 100 bp, Artificial Sequence
  source: /note="Description of Artificial Sequence: Synthetic polynucleotide"
ccggcatctactaatagacgccggccattcaaacatgaggattacccatgtcgaagacaacaaagaagttcaactctttatgtattgatcttcctcgcga

SEQ ID NO: 111 - DNA, 35 bp, Artificial Sequence
  source: /note="Description of Artificial Sequence: Synthetic oligonucleotide"
ggttggaaagccggttttctttgatgtcacggaac

SEQ ID NO: 112 - DNA, 31 bp, Artificial Sequence
  source: /note="Description of Artificial Sequence: Synthetic oligonucleotide"
cgagtagattgctgttctaccaagtaatcca

SEQ ID NO: 113 - DNA, 35 bp, Artificial Sequence; identical to SEQ ID NO: 111
  source: /note="Description of Artificial Sequence: Synthetic oligonucleotide"

SEQ ID NO: 114 - DNA, 31 bp, Artificial Sequence
  source: /note="Description of Artificial Sequence: Synthetic oligonucleotide"
tatgcttccggctcgtatgttgtgtggaatt

SEQ ID NO: 115 - DNA, 35 bp, Artificial Sequence; identical to SEQ ID NO: 111
  source: /note="Description of Artificial Sequence: Synthetic oligonucleotide"

SEQ ID NO: 116 - DNA, 31 bp, Artificial Sequence
  source: /note="Description of Artificial Sequence: Synthetic oligonucleotide"
aacacaggaaacagctatgaccatgattacg

SEQ ID NO: 117 - DNA, 35 bp, Artificial Sequence; identical to SEQ ID NO: 111
  source: /note="Description of Artificial Sequence: Synthetic oligonucleotide"

SEQ ID NO: 118 - DNA, 31 bp, Artificial Sequence
  source: /note="Description of Artificial Sequence: Synthetic oligonucleotide"
aattgtgagcggataaacacaggaaacagct

SEQ ID NO: 119 - DNA, 35 bp, Artificial Sequence; identical to SEQ ID NO: 111
  source: /note="Description of Artificial Sequence: Synthetic oligonucleotide"

SEQ ID NO: 120 - DNA, 31 bp, Artificial Sequence
  source: /note="Description of Artificial Sequence: Synthetic oligonucleotide"
ttgctgttctaccaagtaatccatatttcta

SEQ ID NO: 121 - DNA, 35 bp, Artificial Sequence; identical to SEQ ID NO: 111
  source: /note="Description of Artificial Sequence: Synthetic oligonucleotide"

SEQ ID NO: 122 - DNA, 31 bp, Artificial Sequence
  source: /note="Description of Artificial Sequence: Synthetic oligonucleotide"
tttctagaggatccccgggtaccgagctcga

SEQ ID NO: 123 - DNA, 35 bp, Artificial Sequence; identical to SEQ ID NO: 111
  source: /note="Description of Artificial Sequence: Synthetic oligonucleotide"

SEQ ID NO: 124 - DNA, 31 bp, Artificial Sequence
  source: /note="Description of Artificial Sequence: Synthetic oligonucleotide"
cgccaatataacaatacaggtattatagttg

SEQ ID NO: 125 - DNA, 35 bp, Artificial Sequence; identical to SEQ ID NO: 111
  source: /note="Description of Artificial Sequence: Synthetic oligonucleotide"

SEQ ID NO: 126 - DNA, 31 bp, Artificial Sequence; identical to SEQ ID NO: 51
  source: /note="Description of Artificial Sequence: Synthetic oligonucleotide"

SEQ ID NO: 127 - DNA, 35 bp, Artificial Sequence; identical to SEQ ID NO: 111
  source: /note="Description of Artificial Sequence: Synthetic oligonucleotide"

SEQ ID NO: 128 - DNA, 31 bp, Artificial Sequence
  source: /note="Description of Artificial Sequence: Synthetic oligonucleotide"
cttctttgttgtcttcgacatgggtaatcct

SEQ ID NO: 129 - DNA, 35 bp, Artificial Sequence; identical to SEQ ID NO: 111
  source: /note="Description of Artificial Sequence: Synthetic oligonucleotide"

SEQ ID NO: 130 - DNA, 31 bp, Artificial Sequence; identical to SEQ ID NO: 52
  source: /note="Description of Artificial Sequence: Synthetic oligonucleotide"

SEQ ID NO: 131 - DNA, 35 bp, Artificial Sequence; identical to SEQ ID NO: 111
  source: /note="Description of Artificial Sequence: Synthetic oligonucleotide"

SEQ ID NO: 132 - DNA, 31 bp, Artificial Sequence
  source: /note="Description of Artificial Sequence: Synthetic oligonucleotide"
tctttgttgtcttcgacatgggtaatcctca

SEQ ID NO: 133 - DNA, 35 bp, Artificial Sequence; identical to SEQ ID NO: 111
  source: /note="Description of Artificial Sequence: Synthetic oligonucleotide"

SEQ ID NO: 134 - DNA, 31 bp, Artificial Sequence
  source: /note="Description of Artificial Sequence: Synthetic oligonucleotide"
taatcctcatgtttgaatggccggcgtctat

SEQ ID NO: 135 - DNA, 35 bp, Artificial Sequence; identical to SEQ ID NO: 111
  source: /note="Description of Artificial Sequence: Synthetic oligonucleotide"

SEQ ID NO: 136 - DNA, 31 bp, Artificial Sequence
  source: /note="Description of Artificial Sequence: Synthetic oligonucleotide"
ttcgacatgggtaatcctcatgtttgaatgg

SEQ ID NO: 137 - DNA, 35 bp, Artificial Sequence; identical to SEQ ID NO: 111
  source: /note="Description of Artificial Sequence: Synthetic oligonucleotide"

SEQ ID NO: 138 - DNA, 31 bp, Artificial Sequence
  source: /note="Description of Artificial Sequence: Synthetic oligonucleotide"
cgaggaagatcaatacataaagagttgaact

SEQ ID NO: 139 - DNA, 35 bp, Artificial Sequence; identical to SEQ ID NO: 111
  source: /note="Description of Artificial Sequence: Synthetic oligonucleotide"

SEQ ID NO: 140 - DNA, 31 bp, Artificial Sequence
  source: /note="Description of Artificial Sequence: Synthetic oligonucleotide"
tggtaaatttcgagagaaagatcgcgaggaa

SEQ ID NO: 141 - DNA, 35 bp, Artificial Sequence; identical to SEQ ID NO: 111
  source: /note="Description of Artificial Sequence: Synthetic oligonucleotide"

SEQ ID NO: 142 - DNA, 31 bp, Artificial Sequence
  source: /note="Description of Artificial Sequence: Synthetic oligonucleotide"
ttgaatggccggcgtctattagtagatgccg

SEQ ID NO: 143 - DNA, 35 bp, Artificial Sequence; identical to SEQ ID NO: 111
  source: /note="Description of Artificial Sequence: Synthetic oligonucleotide"

SEQ ID NO: 144 - DNA, 31 bp, Artificial Sequence
  source: /note="Description of Artificial Sequence: Synthetic oligonucleotide"
aatccatatttctagaggatccccgggtacc

SEQ ID NO: 145 - DNA, 35 bp, Artificial Sequence; identical to SEQ ID NO: 111
  source: /note="Description of Artificial Sequence: Synthetic oligonucleotide"

SEQ ID NO: 146 - DNA, 31 bp, Artificial Sequence
  source: /note="Description of Artificial Sequence: Synthetic oligonucleotide"
tgttctaccaagtaatccatatttctagagg

SEQ ID NO: 147 - DNA, 35 bp, Artificial Sequence; identical to SEQ ID NO: 111
  source: /note="Description of Artificial Sequence: Synthetic oligonucleotide"

SEQ ID NO: 148 - DNA, 31 bp, Artificial Sequence
  source: /note="Description of Artificial Sequence: Synthetic oligonucleotide"
tcgagtagattgctgttctaccaagtaatcc

SEQ ID NO: 149 - DNA, 35 bp, Artificial Sequence; identical to SEQ ID NO: 111
  source: /note="Description of Artificial Sequence: Synthetic oligonucleotide"

SEQ ID NO: 150 - DNA, 31 bp, Artificial Sequence
  source: /note="Description of Artificial Sequence: Synthetic oligonucleotide"
gcatgcctgcaggtcgagtagattgctgttc

SEQ ID NO: 151 - DNA, 35 bp, Artificial Sequence; identical to SEQ ID NO: 111
  source: /note="Description of Artificial Sequence: Synthetic oligonucleotide"

SEQ ID NO: 152 - DNA, 31 bp, Artificial Sequence
  source: /note="Description of Artificial Sequence: Synthetic oligonucleotide"
ttacgccaagcttgcatgcctgcaggtcgag

SEQ ID NO: 153 - DNA, 35 bp, Artificial Sequence; identical to SEQ ID NO: 111
  source: /note="Description of Artificial Sequence: Synthetic oligonucleotide"

SEQ ID NO: 154 - DNA, 31 bp, Artificial Sequence
  source: /note="Description of Artificial Sequence: Synthetic oligonucleotide"
gctatgaccatgattacgccaagcttgcatg

SEQ ID NO: 155 - DNA, 35 bp, Artificial Sequence; identical to SEQ ID NO: 111
  source: /note="Description of Artificial Sequence: Synthetic oligonucleotide"

SEQ ID NO: 156 - DNA, 31 bp, Artificial Sequence
  source: /note="Description of Artificial Sequence: Synthetic oligonucleotide"
aatcctcatgtttgaatggccggcgtctatt

SEQ ID NO: 157 - DNA, 35 bp, Artificial Sequence; identical to SEQ ID NO: 111
  source: /note="Description of Artificial Sequence: Synthetic oligonucleotide"

SEQ ID NO: 158 - DNA, 31 bp, Artificial Sequence
  source: /note="Description of Artificial Sequence: Synthetic oligonucleotide"
cttcgacatgggtaatcctcatgtttgaatg

SEQ ID NO: 159 - DNA, 35 bp, Artificial Sequence; identical to SEQ ID NO: 111
  source: /note="Description of Artificial Sequence: Synthetic oligonucleotide"

SEQ ID NO: 160 - DNA, 31 bp, Artificial Sequence
  source: /note="Description of Artificial Sequence: Synthetic oligonucleotide"
acttctttgttgtcttcgacatgggtaatcc

SEQ ID NO: 161 - DNA, 35 bp, Artificial Sequence; identical to SEQ ID NO: 111
  source: /note="Description of Artificial Sequence: Synthetic oligonucleotide"

SEQ ID NO: 162 - DNA, 31 bp, Artificial Sequence
  source: /note="Description of Artificial Sequence: Synthetic oligonucleotide"
cataaagagttgaacttctttgttgtcttcg

SEQ ID NO: 163 - DNA, 35 bp, Artificial Sequence; identical to SEQ ID NO: 111
  source: /note="Description of Artificial Sequence: Synthetic oligonucleotide"

SEQ ID NO: 164 - DNA, 31 bp, Artificial Sequence
  source: /note="Description of Artificial Sequence: Synthetic oligonucleotide"
aggaagatcaatacataaagagttgaacttc

SEQ ID NO: 165 - DNA, 35 bp, Artificial Sequence; identical to SEQ ID NO: 111
  source: /note="Description of Artificial Sequence: Synthetic oligonucleotide"

SEQ ID NO: 166 - DNA, 31 bp, Artificial Sequence
  source: /note="Description of Artificial Sequence: Synthetic oligonucleotide"
gagaaagatcgcgaggaagatcaatacataa

SEQ ID NO: 167 - DNA, 35 bp, Artificial Sequence; identical to SEQ ID NO: 111
  source: /note="Description of Artificial Sequence: Synthetic oligonucleotide"

SEQ ID NO: 168 - DNA, 31 bp, Artificial Sequence
  source: /note="Description of Artificial Sequence: Synthetic oligonucleotide"
agggtgccggtgatgcggcactcgatcttca

SEQ ID NO: 169 - DNA, 35 bp, Artificial Sequence; identical to SEQ ID NO: 111
  source: /note="Description of Artificial Sequence: Synthetic oligonucleotide"

SEQ ID NO: 170 - DNA, 31 bp, Artificial Sequence
  source: /note="Description of Artificial Sequence: Synthetic oligonucleotide"
ccagctcgaactccacgccgttcagggtgcc

SEQ ID NO: 171 - DNA, 35 bp, Artificial Sequence; identical to SEQ ID NO: 111
  source: /note="Description of Artificial Sequence: Synthetic oligonucleotide"

SEQ ID NO: 172 - DNA, 31 bp, Artificial Sequence
  source: /note="Description of Artificial Sequence: Synthetic oligonucleotide"
ccctctccgccgcccaccagctcgaactcca

SEQ ID NO: 173 - DNA, 35 bp, Artificial Sequence; identical to SEQ ID NO: 111
  source: /note="Description of Artificial Sequence: Synthetic oligonucleotide"

SEQ ID NO: 174 - DNA, 31 bp, Artificial Sequence
  source: /note="Description of Artificial Sequence: Synthetic oligonucleotide"
cggccctgctcgggggtgccctctccgccgc

SEQ ID NO: 175 - DNA, 35 bp, Artificial Sequence; identical to SEQ ID NO: 111
  source: /note="Description of Artificial Sequence: Synthetic oligonucleotide"

SEQ ID NO: 176 - DNA, 31 bp, Artificial Sequence
  source: /note="Description of Artificial Sequence: Synthetic oligonucleotide"
acgtggctcagcaggtaggggctgaaggtca

SEQ ID NO: 177 - DNA, 35 bp, Artificial Sequence; identical to SEQ ID NO: 111
  source: /note="Description of Artificial Sequence: Synthetic oligonucleotide"

SEQ ID NO: 178 - DNA, 31 bp, Artificial Sequence
  source: /note="Description of Artificial Sequence: Synthetic oligonucleotide"
aggtgccgaagtggtagaagccgtagcccat

SEQ ID NO: 179 - DNA, 35 bp, Artificial Sequence; identical to SEQ ID NO: 111
  source: /note="Description of Artificial Sequence: Synthetic oligonucleotide"

SEQ ID NO: 180 - DNA, 31 bp, Artificial Sequence
  source: /note="Description of Artificial Sequence: Synthetic oligonucleotide"
tggcgtgcaggaaggggttctcgtagccgct

SEQ ID NO: 181 - DNA, 35 bp, Artificial Sequence; identical to SEQ ID NO: 111
  source: /note="Description of Artificial Sequence: Synthetic oligonucleotide"

SEQ ID NO: 182 - DNA, 31 bp, Artificial Sequence
  source: /note="Description of Artificial Sequence: Synthetic oligonucleotide"
gtacttctcgatgcgggtgttggtgtagccg

SEQ ID NO: 183 - DNA, 35 bp, Artificial Sequence; identical to SEQ ID NO: 111
  source: /note="Description of Artificial Sequence: Synthetic oligonucleotide"

SEQ ID NO: 184 - DNA, 31 bp, Artificial Sequence
  source: /note="Description of Artificial Sequence: Synthetic oligonucleotide"
gcggccggcctcgtagcggtagctgaagctc

SEQ ID NO: 185 - DNA, 35 bp, Artificial Sequence; identical to SEQ ID NO: 111
  source: /note="Description of Artificial Sequence: Synthetic oligonucleotide"

SEQ ID NO: 186 - DNA, 31 bp, Artificial Sequence
  source: /note="Description of Artificial Sequence: Synthetic oligonucleotide"
aagccggtgcccaccaccttgaagtcgccga

SEQ ID NO: 187 - DNA, 35 bp, Artificial Sequence; identical to SEQ ID NO: 111
  source: /note="Description of Artificial Sequence: Synthetic oligonucleotide"

SEQ ID NO: 188 - DNA, 31 bp, Artificial Sequence
  source: /note="Description of Artificial Sequence: Synthetic oligonucleotide"
aagatcacgctgtcctcggggaagccggtgc

SEQ ID NO: 189 - DNA, 36 bp, Artificial Sequence
  source: /note="Description of Artificial Sequence: Synthetic oligonucleotide"
gtttggaagccgggtcgaagtcaggcccgttaagac

SEQ ID NO: 190 - DNA, 31 bp, Artificial Sequence; identical to SEQ ID NO: 51
  source: /note="Description of Artificial Sequence: Synthetic oligonucleotide"

SEQ ID NO: 191 - DNA, 36 bp, Artificial Sequence
  source: /note="Description of Artificial Sequence: Synthetic oligonucleotide"
cttgaagactaaaggaaggaattaatgtcacggtac

SEQ ID NO: 192 - DNA, 31 bp, Artificial Sequence; identical to SEQ ID NO: 51
  source: /note="Description of Artificial Sequence: Synthetic oligonucleotide"

SEQ ID NO: 193 - DNA, 36 bp, Artificial Sequence; identical to SEQ ID NO: 189
  source: /note="Description of Artificial Sequence: Synthetic oligonucleotide"

SEQ ID NO: 194 - DNA, 31 bp, Artificial Sequence; identical to SEQ ID NO: 124
  source: /note="Description of Artificial Sequence: Synthetic oligonucleotide"

SEQ ID NO: 195 - DNA, 36 bp, Artificial Sequence; identical to SEQ ID NO: 191
  source: /note="Description of Artificial Sequence: Synthetic oligonucleotide"

SEQ ID NO: 196 - DNA, 31 bp, Artificial Sequence; identical to SEQ ID NO: 124
  source: /note="Description of Artificial Sequence: Synthetic oligonucleotide"

SEQ ID NO: 197 - DNA, 34 bp, Artificial Sequence
  source: /note="Description of Artificial Sequence: Synthetic oligonucleotide"
gttggaaagccggttttctttgatgtcacggaac

SEQ ID NO: 198 - DNA, 31 bp, Artificial Sequence; identical to SEQ ID NO: 51
  source: /note="Description of Artificial Sequence: Synthetic oligonucleotide"

SEQ ID NO: 199 - DNA, 31 bp, Artificial Sequence
  source: /note="Description of Artificial Sequence: Synthetic oligonucleotide"
ggaaagccggttttctttgatgtcacggaac

SEQ ID NO: 200 - DNA, 31 bp, Artificial Sequence; identical to SEQ ID NO: 51
  source: /note="Description of Artificial Sequence: Synthetic oligonucleotide"

SEQ ID NO: 201 - DNA, 28 bp, Artificial Sequence
  source: /note="Description of Artificial Sequence: Synthetic oligonucleotide"
aagccggttttctttgatgtcacggaac

SEQ ID NO: 202 - DNA, 31 bp, Artificial Sequence; identical to SEQ ID NO: 51
  source: /note="Description of Artificial Sequence: Synthetic oligonucleotide"

SEQ ID NO: 203 - DNA, 25 bp, Artificial Sequence
  source: /note="Description of Artificial Sequence: Synthetic oligonucleotide"
ccggttttctttgatgtcacggaac

SEQ ID NO: 204 - DNA, 31 bp, Artificial Sequence; identical to SEQ ID NO: 51
  source: /note="Description of Artificial Sequence: Synthetic oligonucleotide"

SEQ ID NO: 205 - DNA, 22 bp, Artificial Sequence
  source: /note="Description of Artificial Sequence: Synthetic oligonucleotide"
gttttctttgatgtcacggaac

SEQ ID NO: 206 - DNA, 31 bp, Artificial Sequence; identical to SEQ ID NO: 51
  source: /note="Description of Artificial Sequence: Synthetic oligonucleotide"

SEQ ID NO: 207 - DNA, 18 bp, Artificial Sequence
  source: /note="Description of Artificial Sequence: Synthetic oligonucleotide"
tctttgatgtcacggaac

SEQ ID NO: 208 - DNA, 31 bp, Artificial Sequence; identical to SEQ ID NO: 51
  source: /note="Description of Artificial Sequence: Synthetic oligonucleotide"

SEQ ID NO: 209 - DNA, 15 bp, Artificial Sequence
  source: /note="Description of Artificial Sequence: Synthetic oligonucleotide"
ttgatgtcacggaac

SEQ ID NO: 210 - DNA, 31 bp, Artificial Sequence; identical to SEQ ID NO: 51
  source: /note="Description of Artificial Sequence: Synthetic oligonucleotide"

SEQ ID NO: 211 - DNA, 12 bp, Artificial Sequence
  source: /note="Description of Artificial Sequence: Synthetic oligonucleotide"
atgtcacggaac

SEQ ID NO: 212 - DNA, 31 bp, Artificial Sequence; identical to SEQ ID NO: 51
  source: /note="Description of Artificial Sequence: Synthetic oligonucleotide"

SEQ ID NO: 213 - DNA, 9 bp, Artificial Sequence
  source: /note="Description of Artificial Sequence: Synthetic oligonucleotide"
tcacggaac

SEQ ID NO: 214 - DNA, 31 bp, Artificial Sequence; identical to SEQ ID NO: 51
  source: /note="Description of Artificial Sequence: Synthetic oligonucleotide"

SEQ ID NO: 215 - DNA, 6 bp, Artificial Sequence
  source: /note="Description of Artificial Sequence: Synthetic oligonucleotide"
cggaac

SEQ ID NO: 216 - DNA, 31 bp, Artificial Sequence; identical to SEQ ID NO: 51
  source: /note="Description of Artificial Sequence: Synthetic oligonucleotide"

SEQ ID NO: 217 - DNA, 35 bp, Artificial Sequence; identical to SEQ ID NO: 111
  source: /note="Description of Artificial Sequence: Synthetic oligonucleotide"

SEQ ID NO: 218 - DNA, 30 bp, Artificial Sequence
  source: /note="Description of Artificial Sequence: Synthetic oligonucleotide"
ctttgttgtcttcgacatgggtaatcctca

SEQ ID NO: 219 - DNA, 35 bp, Artificial Sequence; identical to SEQ ID NO: 111
  source: /note="Description of Artificial Sequence: Synthetic oligonucleotide"

SEQ ID NO: 220 - DNA, 28 bp, Artificial Sequence
  source: /note="Description of Artificial Sequence: Synthetic oligonucleotide"
ctttgttgtcttcgacatgggtaatcct

SEQ ID NO: 221 - DNA, 35 bp, Artificial Sequence; identical to SEQ ID NO: 111
  source: /note="Description of Artificial Sequence: Synthetic oligonucleotide"

SEQ ID NO: 222 - DNA, 25 bp, Artificial Sequence
  source: /note="Description of Artificial Sequence: Synthetic oligonucleotide"
ctttgttgtcttcgacatgggtaat

SEQ ID NO: 223 - DNA, 35 bp, Artificial Sequence; identical to SEQ ID NO: 111
  source: /note="Description of Artificial Sequence: Synthetic oligonucleotide"

SEQ ID NO: 224 - DNA, 22 bp, Artificial Sequence
  source: /note="Description of Artificial Sequence: Synthetic oligonucleotide"
ctttgttgtcttcgacatgggt

SEQ ID NO: 225 - DNA, 35 bp, Artificial Sequence; identical to SEQ ID NO: 111
  source: /note="Description of Artificial Sequence: Synthetic oligonucleotide"

SEQ ID NO: 226 - DNA, 19 bp, Artificial Sequence
  source: /note="Description of Artificial Sequence: Synthetic oligonucleotide"
ctttgttgtcttcgacatg

SEQ ID NO: 227 - DNA, 35 bp, Artificial Sequence; identical to SEQ ID NO: 111
  source: /note="Description of Artificial Sequence: Synthetic oligonucleotide"

SEQ ID NO: 228 - DNA, 16 bp, Artificial Sequence
  source: /note="Description of Artificial Sequence: Synthetic oligonucleotide"
ctttgttgtcttcgac

SEQ ID NO: 229 - DNA, 35 bp, Artificial Sequence; identical to SEQ ID NO: 111
  source: /note="Description of Artificial Sequence: Synthetic oligonucleotide"

SEQ ID NO: 230 - DNA, 13 bp, Artificial Sequence
  source: /note="Description of Artificial Sequence: Synthetic oligonucleotide"
ctttgttgtcttc

SEQ ID NO: 231 - DNA, 35 bp, Artificial Sequence; identical to SEQ ID NO: 111
  source: /note="Description of Artificial Sequence: Synthetic oligonucleotide"

SEQ ID NO: 232 - DNA, 10 bp, Artificial Sequence
  source: /note="Description of Artificial Sequence: Synthetic oligonucleotide"
ctttgttgtc

SEQ ID NO: 233 - DNA, 15 bp, Artificial Sequence
  source: /note="Description of Artificial Sequence: Synthetic oligonucleotide"
ttgatgtcacggaac

SEQ ID NO: 234 - DNA, 31 bp, Artificial Sequence; identical to SEQ ID NO: 51
  source: /note="Description of Artificial Sequence: Synthetic oligonucleotide"

SEQ ID NO: 235 - DNA, 15 bp, Artificial Sequence
  source: /note="Description of Artificial Sequence: Synthetic oligonucleotide"
atgatgtcacggaac

SEQ ID NO: 236 - DNA, 31 bp, Artificial Sequence; identical to SEQ ID NO: 51
  source: /note="Description of Artificial Sequence: Synthetic oligonucleotide"

SEQ ID NO: 237 - DNA, 15 bp, Artificial Sequence
  source: /note="Description of Artificial Sequence: Synthetic oligonucleotide"
tagatgtcacggaac

SEQ ID NO: 238 - DNA, 31 bp, Artificial Sequence; identical to SEQ ID NO: 51
  source: /note="Description of Artificial Sequence: Synthetic oligonucleotide"

SEQ ID NO: 239 - DNA, 15 bp, Artificial Sequence
  source: /note="Description of Artificial Sequence: Synthetic oligonucleotide"
ttcatgtcacggaac

SEQ ID NO: 240 - DNA, 31 bp, Artificial Sequence; identical to SEQ ID NO: 51
  source: /note="Description of Artificial Sequence: Synthetic oligonucleotide"

SEQ ID NO: 241 - DNA, 15 bp, Artificial Sequence
  source: /note="Description of Artificial Sequence: Synthetic oligonucleotide"
ttgttgtcacggaac

SEQ ID NO: 242 - DNA, 31 bp, Artificial Sequence; identical to SEQ ID NO: 51
  source: /note="Description of Artificial Sequence: Synthetic oligonucleotide"

SEQ ID NO: 243 - DNA, 15 bp, Artificial Sequence
  source: /note="Description of Artificial Sequence: Synthetic oligonucleotide"
ttgaagtcacggaac

SEQ ID NO: 244 - DNA, 31 bp, Artificial Sequence; identical to SEQ ID NO: 51
  source: /note="Description of Artificial Sequence: Synthetic oligonucleotide"

SEQ ID NO: 245 - DNA, 15 bp, Artificial Sequence
  source: /note="Description of Artificial Sequence: Synthetic oligonucleotide"
ttgatctcacggaac

SEQ ID NO: 246 - DNA, 31 bp, Artificial Sequence; identical to SEQ ID NO: 51
  source: /note="Description of Artificial Sequence: Synthetic oligonucleotide"

SEQ ID NO: 247 - DNA, 15 bp, Artificial Sequence
  source: /note="Description of Artificial Sequence: Synthetic oligonucleotide"
ttgatgacacggaac

SEQ ID NO: 248 - DNA, 31 bp, Artificial Sequence; identical to SEQ ID NO: 51
  source: /note="Description of Artificial Sequence: Synthetic oligonucleotide"

SEQ ID NO: 249 - DNA, 15 bp, Artificial Sequence
  source: /note="Description of Artificial Sequence: Synthetic oligonucleotide"
ttgatgtgacggaac

SEQ ID NO: 250 - DNA, 31 bp, Artificial Sequence; identical to SEQ ID NO: 51
  source: /note="Description of Artificial Sequence: Synthetic oligonucleotide"

SEQ ID NO: 251 - DNA, 15 bp, Artificial Sequence
  source: /note="Description of Artificial Sequence: Synthetic oligonucleotide"
ttgatgtctcggaac

SEQ ID NO: 252 - DNA, 31 bp, Artificial Sequence; identical to SEQ ID NO: 51
  source: /note="Description of Artificial Sequence: Synthetic oligonucleotide"

SEQ ID NO: 253 - DNA, 15 bp, Artificial Sequence
  source: /note="Description of Artificial Sequence: Synthetic oligonucleotide"
ttgatgtcagggaac

SEQ ID NO: 254 - DNA, 31 bp, Artificial Sequence; identical to SEQ ID NO: 51
  source: /note="Description of Artificial Sequence: Synthetic oligonucleotide"

SEQ ID NO: 255 - DNA, 15 bp, Artificial Sequence
  source: /note="Description of Artificial Sequence: Synthetic oligonucleotide"
ttgatgtcaccgaac

SEQ ID NO: 256 - DNA, 31 bp, Artificial Sequence; identical to SEQ ID NO: 51
  source: /note="Description of Artificial Sequence: Synthetic oligonucleotide"

SEQ ID NO: 257 - DNA, 15 bp, Artificial Sequence
  source: /note="Description of Artificial Sequence: Synthetic oligonucleotide"
ttgatgtcacgcaac

SEQ ID NO: 258 - DNA, 31 bp, Artificial Sequence; identical to SEQ ID NO: 51
  source: /note="Description of Artificial Sequence: Synthetic oligonucleotide"

SEQ ID NO: 259 - DNA, 15 bp, Artificial Sequence
  source: /note="Description of Artificial Sequence: Synthetic oligonucleotide"
ttgatgtcacggtac

SEQ ID NO: 260 - DNA, 31 bp, Artificial Sequence; identical to SEQ ID NO: 51
  source: /note="Description of Artificial Sequence: Synthetic oligonucleotide"

SEQ ID NO: 261 - DNA, 15 bp, Artificial Sequence
  source: /note="Description of Artificial Sequence: Synthetic oligonucleotide"
ttgatgtcacggatc

SEQ ID NO: 262 - DNA, 31 bp, Artificial Sequence; identical to SEQ ID NO: 51
  source: /note="Description of Artificial Sequence: Synthetic oligonucleotide"

SEQ ID NO: 263 - DNA, 15 bp, Artificial Sequence
  source: /note="Description of Artificial Sequence: Synthetic oligonucleotide"
ttgatgtcacggaag

SEQ ID NO: 264 - DNA, 31 bp, Artificial Sequence; identical to SEQ ID NO: 51
  source: /note="Description of Artificial Sequence: Synthetic oligonucleotide"

SEQ ID NO: 265 - DNA, 15 bp, Artificial Sequence
  source: /note="Description of Artificial Sequence: Synthetic oligonucleotide"
ttgatgtcacggaac

SEQ ID NO: 266 - DNA, 31 bp, Artificial Sequence; identical to SEQ ID NO: 51
  source: /note="Description of Artificial Sequence: Synthetic oligonucleotide"

SEQ ID NO: 267 - DNA, 15 bp, Artificial Sequence
  source: /note="Description of Artificial Sequence: Synthetic oligonucleotide"
aagatgtcacggaac

SEQ ID NO: 268 - DNA, 31 bp, Artificial Sequence; identical to SEQ ID NO: 51
  source: /note="Description of Artificial Sequence: Synthetic oligonucleotide"

SEQ ID NO: 269 - DNA, 15 bp, Artificial Sequence
  source: /note="Description of Artificial Sequence: Synthetic oligonucleotide"
tacatgtcacggaac

SEQ ID NO: 270 - DNA, 31 bp, Artificial Sequence; identical to SEQ ID NO: 51
  source: /note="Description of Artificial Sequence: Synthetic oligonucleotide"

SEQ ID NO: 271 - DNA, 15 bp, Artificial Sequence
  source: /note="Description of Artificial Sequence: Synthetic oligonucleotide"
ttcttgtcacggaac

SEQ ID NO: 272 - DNA, 31 bp, Artificial Sequence; identical to SEQ ID NO: 51
  source: /note="Description of Artificial Sequence: Synthetic oligonucleotide"

SEQ ID NO: 273 - DNA, 15 bp, Artificial Sequence
  source: /note="Description of Artificial Sequence: Synthetic oligonucleotide"
ttgtagtcacggaac

SEQ ID NO: 274 - DNA, 31 bp, Artificial Sequence; identical to SEQ ID NO: 51
  source: /note="Description of Artificial Sequence: Synthetic oligonucleotide"

SEQ ID NO: 275 - DNA, 15 bp, Artificial Sequence
  source: /note="Description of Artificial Sequence: Synthetic oligonucleotide"
ttgaactcacggaac

SEQ ID NO: 276 - DNA, 31 bp, Artificial Sequence; identical to SEQ ID NO: 51
  source: /note="Description of Artificial Sequence: Synthetic oligonucleotide"

SEQ ID NO: 277 - DNA, 15 bp, Artificial Sequence
  source: /note="Description of Artificial Sequence: Synthetic oligonucleotide"
ttgatcacacggaac

SEQ ID NO: 278 - DNA, 31 bp, Artificial Sequence; identical to SEQ ID NO: 51
  source: /note="Description of Artificial Sequence: Synthetic oligonucleotide"

SEQ ID NO: 279 - DNA, 15 bp, Artificial Sequence
  source: /note="Description of Artificial Sequence: Synthetic oligonucleotide"
ttgatgagacggaac

SEQ ID NO: 280 - DNA, 31 bp, Artificial Sequence; identical to SEQ ID NO: 51
  source: /note="Description of Artificial Sequence: Synthetic oligonucleotide"

SEQ ID NO: 281 - DNA, 15 bp, Artificial Sequence
  source: /note="Description of Artificial Sequence: Synthetic oligonucleotide"
ttgatgtgtcggaac

SEQ ID NO: 282 - DNA, 31 bp, Artificial Sequence; identical to SEQ ID NO: 51
  source: /note="Description of Artificial Sequence: Synthetic oligonucleotide"

SEQ ID NO: 283 - DNA, 15 bp, Artificial Sequence
  source: /note="Description of Artificial Sequence: Synthetic oligonucleotide"
ttgatgtctgggaac

SEQ ID NO: 284 - DNA, 31 bp, Artificial Sequence; identical to SEQ ID NO: 51
  source: /note="Description of Artificial Sequence: Synthetic oligonucleotide"

SEQ ID NO: 285 - DNA, 15 bp, Artificial Sequence
  source: /note="Description of Artificial Sequence: Synthetic oligonucleotide"
ttgatgtcagcgaac

SEQ ID NO: 286 - DNA, 31 bp, Artificial Sequence; identical to SEQ ID NO: 51
  source: /note="Description of Artificial Sequence: Synthetic oligonucleotide"

SEQ ID NO: 287 - DNA, 15 bp, Artificial Sequence
  source: /note="Description of Artificial Sequence: Synthetic oligonucleotide"
ttgatgtcacccaac

SEQ ID NO: 288 - DNA, 31 bp, Artificial Sequence; identical to SEQ ID NO: 51
  source: /note="Description of Artificial Sequence: Synthetic oligonucleotide"

SEQ ID NO: 289 - DNA, 15 bp, Artificial Sequence
  source: /note="Description of Artificial Sequence: Synthetic oligonucleotide"
ttgatgtcacgctac

SEQ ID NO: 290 - DNA, 31 bp, Artificial Sequence; identical to SEQ ID NO: 51
  source: /note="Description of Artificial Sequence: Synthetic oligonucleotide"

SEQ ID NO: 291 - DNA, 15 bp, Artificial Sequence
  source: /note="Description of Artificial Sequence: Synthetic oligonucleotide"
ttgatgtcacggttc

SEQ ID NO: 292 - DNA, 31 bp, Artificial Sequence; identical to SEQ ID NO: 51
  source: /note="Description of Artificial Sequence: Synthetic oligonucleotide"

SEQ ID NO: 293 - DNA, 15 bp, Artificial Sequence
  source: /note="Description of Artificial Sequence: Synthetic oligonucleotide"
ttgatgtcacggatg

SEQ ID NO: 294 - DNA, 31 bp, Artificial Sequence; identical to SEQ ID NO: 51
  source: /note="Description of Artificial Sequence: Synthetic oligonucleotide"

SEQ ID NO: 295 - DNA, 35 bp, Artificial Sequence; identical to SEQ ID NO: 111
  source: /note="Description of Artificial Sequence: Synthetic oligonucleotide"

SEQ ID NO: 296 - DNA, 31 bp, Artificial Sequence
  source: /note="Description of Artificial Sequence: Synthetic oligonucleotide"
accaaacgtaatgcggggtgcatttcgctga

SEQ ID NO: 297 - DNA, 35 bp, Artificial Sequence; identical to SEQ ID NO: 111
  source: /note="Description of Artificial Sequence: Synthetic oligonucleotide"

SEQ ID NO: 298 - DNA, 31 bp, Artificial Sequence
  source: /note="Description of Artificial Sequence: Synthetic oligonucleotide"
gttgaatctgagggtccaccaaacgtaatgc

SEQ ID NO: 299 - DNA, 35 bp, Artificial Sequence; identical to SEQ ID NO: 111
  source: /note="Description of Artificial Sequence: Synthetic oligonucleotide"

SEQ ID NO: 300 - DNA, 31 bp, Artificial Sequence
  source: /note="Description of Artificial Sequence: Synthetic oligonucleotide"
cattctggttactgccagttgaatctgaggg

SEQ ID NO: 301 - DNA, 35 bp, Artificial Sequence; identical to SEQ ID NO: 111
  source: /note="Description of Artificial Sequence: Synthetic oligonucleotide"

SEQ ID NO: 302 - DNA, 31 bp, Artificial Sequence
  source: /note="Description of Artificial Sequence: Synthetic oligonucleotide"
gccccactgcgttctccattctggttactgc

SEQ ID NO: 303 - DNA, 35 bp, Artificial Sequence; identical to SEQ ID NO: 111
  source: /note="Description of Artificial Sequence: Synthetic oligonucleotide"

SEQ ID NO: 304 - DNA, 31 bp, Artificial Sequence
  source: /note="Description of Artificial Sequence: Synthetic oligonucleotide"
acgttgttttgatcgcgccccactgcgttct

SEQ ID NO: 305 - DNA, 35 bp, Artificial Sequence; identical to SEQ ID NO: 111
  source: /note="Description of Artificial Sequence: Synthetic oligonucleotide"

SEQ ID NO: 306 - DNA, 31 bp, Artificial Sequence
  source: /note="Description of Artificial Sequence: Synthetic oligonucleotide"
ggtaaaccttggggccgacgttgttttgatc

SEQ ID NO: 307 - DNA, 35 bp, Artificial Sequence; identical to SEQ ID NO: 111
  source: /note="Description of Artificial Sequence: Synthetic oligonucleotide"

SEQ ID NO: 308 - DNA, 31 bp, Artificial Sequence
  source: /note="Description of Artificial Sequence: Synthetic oligonucleotide"
agacgcagtattattgggtaaaccttggggc

SEQ ID NO: 309 - DNA, 35 bp, Artificial Sequence; identical to SEQ ID NO: 111
  source: /note="Description of Artificial Sequence: Synthetic oligonucleotide"

SEQ ID NO: 310 - DNA, 31 bp, Artificial Sequence
  source: /note="Description of Artificial Sequence: Synthetic oligonucleotide"
tgagagcggtgaaccaagacgcagtattatt

SEQ ID NO: 311 - DNA, 35 bp, Artificial Sequence; identical to SEQ ID NO: 111
  source: /note="Description of Artificial Sequence: Synthetic oligonucleotide"

SEQ ID NO: 312 - DNA, 31 bp, Artificial Sequence
  source: /note="Description of Artificial Sequence: Synthetic oligonucleotide"
ccgggaagtttttgagcgaaaaccagacata

SEQ ID NO: 313 - DNA, 35 bp, Artificial Sequence; identical to SEQ ID NO: 111
  source: /note="Description of Artificial Sequence: Synthetic oligonucleotide"

SEQ ID NO: 314 - DNA, 31 bp, Artificial Sequence
  source: /note="Description of Artificial Sequence: Synthetic oligonucleotide"
cgtgctgttgtcatttccgggaagtttttga

SEQ ID NO: 315 - DNA, 35 bp, Artificial Sequence; identical to SEQ ID NO: 111
  source: /note="Description of Artificial Sequence: Synthetic oligonucleotide"

SEQ ID NO: 316 - DNA, 31 bp, Artificial Sequence
  source: /note="Description of Artificial Sequence: Synthetic oligonucleotide"
caaggcacagcgttgccgtgctgttgtcatt

SEQ ID NO: 317 - DNA, 35 bp, Artificial Sequence; identical to SEQ ID NO: 111
  source: /note="Description of Artificial Sequence: Synthetic oligonucleotide"

SEQ ID NO: 318 - DNA, 31 bp, Artificial Sequence
  source: /note="Description of Artificial Sequence: Synthetic oligonucleotide"
ggtactgcatggtgcccaaggcacagcgttg

SEQ ID NO: 319 - DNA, 35 bp, Artificial Sequence; identical to SEQ ID NO: 111
  source: /note="Description of Artificial Sequence: Synthetic oligonucleotide"

SEQ ID NO: 320 - DNA, 31 bp, Artificial Sequence
  source: /note="Description of Artificial Sequence: Synthetic oligonucleotide"
tcactatcgttccgtttggtactgcatggtg

SEQ ID NO: 321 - DNA, 35 bp, Artificial Sequence; identical to SEQ ID NO: 111
  source: /note="Description of Artificial Sequence: Synthetic oligonucleotide"

SEQ ID NO: 322 - DNA, 31 bp, Artificial Sequence
  source: /note="Description of Artificial Sequence: Synthetic oligonucleotide"
gtcattcgtgattgttttcactatcgttccg

SEQ ID NO: 323 - DNA, 35 bp, Artificial Sequence; identical to SEQ ID NO: 111
  source: /note="Description of Artificial Sequence: Synthetic oligonucleotide"

SEQ ID NO: 324 - DNA, 31 bp, Artificial Sequence
  source: /note="Description of Artificial Sequence: Synthetic oligonucleotide"
agtgacttcaatttggtcattcgtgattgtt

SEQ ID NO: 325 - DNA, 35 bp, Artificial Sequence; identical to SEQ ID NO: 111
  source: /note="Description of Artificial Sequence: Synthetic oligonucleotide"

SEQ ID NO: 326 - DNA, 31 bp, Artificial Sequence
  source: /note="Description of Artificial Sequence: Synthetic oligonucleotide"
accagttcagtagcattagtgacttcaattt

SEQ ID NO: 327 - DNA, 35 bp, Artificial Sequence; identical to SEQ ID NO: 111
  source: /note="Description of Artificial Sequence: Synthetic oligonucleotide"

SEQ ID NO: 328 - DNA, 31 bp, Artificial Sequence
  source: /note="Description of Artificial Sequence: Synthetic oligonucleotide"
tggggtgcaggtgctccacggtggcgttgct

SEQ ID NO: 329 - DNA, 35 bp, Artificial Sequence; identical to SEQ ID NO: 111
  source: /note="Description of Artificial Sequence: Synthetic oligonucleotide"

SEQ ID NO: 330 - DNA, 31 bp, Artificial Sequence
  source: /note="Description of Artificial Sequence: Synthetic oligonucleotide"
aaggtgcgggcgaagctgcccaccagcacgt

SEQ ID NO: 331 - DNA, 35 bp, Artificial Sequence; identical to SEQ ID NO: 111
  source: /note="Description of Artificial Sequence: Synthetic oligonucleotide"

SEQ ID NO: 332 - DNA, 31 bp, Artificial Sequence
  source: /note="Description of Artificial Sequence: Synthetic oligonucleotide"
gtccaccacgaagctgtagtagccgccgtcg

SEQ ID NO: 333 - DNA, 35 bp, Artificial Sequence; identical to SEQ ID NO: 111
  source: /note="Description of Artificial Sequence: Synthetic oligonucleotide"

SEQ ID NO: 334 - DNA, 31 bp, Artificial Sequence
  source: /note="Description of Artificial Sequence: Synthetic oligonucleotide"
tgctggggtggatggcgctcttgaagtgcat

SEQ ID NO: 335 - DNA, 35 bp, Artificial Sequence; identical to SEQ ID NO: 111
  source: /note="Description of Artificial Sequence: Synthetic oligonucleotide"

SEQ ID NO: 336 - DNA, 31 bp, Artificial Sequence
  source: /note="Description of Artificial Sequence: Synthetic oligonucleotide"
ggaaggcgaacatggggcccccgttctgcag

SEQ ID NO: 337 - DNA, 35 bp, Artificial Sequence; identical to SEQ ID NO: 111
  source: /note="Description of Artificial Sequence: Synthetic oligonucleotide"

SEQ ID NO: 338 - DNA, 31 bp, Artificial Sequence; identical to SEQ ID NO: 156
  source: /note="Description of Artificial Sequence: Synthetic oligonucleotide"

SEQ ID NO: 339 - DNA, 35 bp, Artificial Sequence; identical to SEQ ID NO: 111
  source: /note="Description of Artificial Sequence: Synthetic oligonucleotide"

SEQ ID NO: 340 - DNA, 31 bp, Artificial Sequence
  source: /note="Description of Artificial Sequence: Synthetic oligonucleotide"
ggtaatcctcatgtttgaatggccggcgtct

SEQ ID NO: 341 - DNA, 35 bp, Artificial Sequence; identical to SEQ ID NO: 111
  source: /note="Description of Artificial Sequence: Synthetic oligonucleotide"

SEQ ID NO: 342 - DNA, 31 bp, Artificial Sequence
  source: /note="Description of Artificial Sequence: Synthetic oligonucleotide"
atgggtaatcctcatgtttgaatggccggcg

SEQ ID NO: 343 - DNA, 35 bp, Artificial Sequence; identical to SEQ ID NO: 111
  source: /note="Description of Artificial Sequence: Synthetic oligonucleotide"

SEQ ID NO: 344 - DNA, 31 bp, Artificial Sequence
  source: /note="Description of Artificial Sequence: Synthetic oligonucleotide"
gacatgggtaatcctcatgtttgaatggccg

SEQ ID NO: 345 - DNA, 35 bp, Artificial Sequence; identical to SEQ ID NO: 111
  source: /note="Description of Artificial Sequence: Synthetic oligonucleotide"

SEQ ID NO: 346 - DNA, 31 bp, Artificial Sequence; identical to SEQ ID NO: 136
  source: /note="Description of Artificial Sequence: Synthetic oligonucleotide"

SEQ ID NO: 347 - DNA, 35 bp, Artificial Sequence; identical to SEQ ID NO: 111
  source: /note="Description of Artificial Sequence: Synthetic oligonucleotide"

SEQ ID NO: 348 - DNA, 31 bp, Artificial Sequence
  source: /note="Description of Artificial Sequence: Synthetic oligonucleotide"
gtcttcgacatgggtaatcctcatgtttgaa

SEQ ID NO: 349 - DNA, 35 bp, Artificial Sequence; identical to SEQ ID NO: 111
  source: /note="Description of Artificial Sequence: Synthetic oligonucleotide"

SEQ ID NO: 350 - DNA, 31 bp, Artificial Sequence
  source: /note="Description of Artificial Sequence: Synthetic oligonucleotide"
gttgtcttcgacatgggtaatcctcatgttt

SEQ ID NO: 351 - DNA, 35 bp, Artificial Sequence; identical to SEQ ID NO: 111
  source: /note="Description of Artificial Sequence: Synthetic oligonucleotide"

SEQ ID NO: 352 - DNA, 31 bp, Artificial Sequence
  source: /note="Description of Artificial Sequence: Synthetic oligonucleotide"
tttgttgtcttcgacatgggtaatcctcatg

SEQ ID NO: 353 - DNA, 35 bp, Artificial Sequence; identical to SEQ ID NO: 111
  source: /note="Description of Artificial Sequence: Synthetic oligonucleotide"

SEQ ID NO: 354 - DNA, 31 bp, Artificial Sequence
  source: /note="Description of Artificial Sequence: Synthetic oligonucleotide"
ttctttgttgtcttcgacatgggtaatcctc

SEQ ID NO: 355 - DNA, 35 bp, Artificial Sequence; identical to SEQ ID NO: 111
  source: /note="Description of Artificial Sequence: Synthetic oligonucleotide"

SEQ ID NO: 356 - DNA, 31 bp, Artificial Sequence
  source: /note="Description of Artificial Sequence: Synthetic oligonucleotide"
aacttctttgttgtcttcgacatgggtaatc

SEQ ID NO: 357 - DNA, 36 bp, Artificial Sequence; identical to SEQ ID NO: 191
  source: /note="Description of Artificial Sequence: Synthetic oligonucleotide"

SEQ ID NO: 358 - DNA, 31 bp, Artificial Sequence; identical to SEQ ID NO: 156
  source: /note="Description of Artificial Sequence: Synthetic oligonucleotide"

SEQ ID NO: 359 - DNA, 36 bp, Artificial Sequence; identical to SEQ ID NO: 191
  source: /note="Description of Artificial Sequence: Synthetic oligonucleotide"

SEQ ID NO: 360 - DNA, 31 bp, Artificial Sequence; identical to SEQ ID NO: 340
  source: /note="Description of Artificial Sequence: Synthetic oligonucleotide"

SEQ ID NO: 361 - DNA, 36 bp, Artificial Sequence; identical to SEQ ID NO: 191
  source: /note="Description of Artificial Sequence: Synthetic oligonucleotide"

SEQ ID NO: 362 - DNA, 31 bp, Artificial Sequence; identical to SEQ ID NO: 342
  source: /note="Description of Artificial Sequence: Synthetic oligonucleotide"

SEQ ID NO: 363 - DNA, 36 bp, Artificial Sequence; identical to SEQ ID NO: 191
  source: /note="Description of Artificial Sequence: Synthetic oligonucleotide"

SEQ ID NO: 364 - DNA, 31 bp, Artificial Sequence; identical to SEQ ID NO: 344
  source: /note="Description of Artificial Sequence: Synthetic oligonucleotide"

SEQ ID NO: 365 - DNA, 36 bp, Artificial Sequence; identical to SEQ ID NO: 191
  source: /note="Description of Artificial Sequence: Synthetic oligonucleotide"

SEQ ID NO: 366 - DNA, 31 bp, Artificial Sequence; identical to SEQ ID NO: 136
  source: /note="Description of Artificial Sequence: Synthetic oligonucleotide"

SEQ ID NO: 367 - DNA, 36 bp, Artificial Sequence; identical to SEQ ID NO: 191
  source: /note="Description of Artificial Sequence: Synthetic oligonucleotide"

SEQ ID NO: 368 - DNA, 31 bp, Artificial Sequence; identical to SEQ ID NO: 348
  source: /note="Description of Artificial Sequence: Synthetic oligonucleotide"

SEQ ID NO: 369 - DNA, 36 bp, Artificial Sequence; identical to SEQ ID NO: 191
  source: /note="Description of Artificial Sequence: Synthetic oligonucleotide"

SEQ ID NO: 370 - DNA, 31 bp, Artificial Sequence; identical to SEQ ID NO: 350
  source: /note="Description of Artificial Sequence: Synthetic oligonucleotide"

SEQ ID NO: 371 - DNA, 36 bp, Artificial Sequence; identical to SEQ ID NO: 191
  source: /note="Description of Artificial Sequence: Synthetic oligonucleotide"

SEQ ID NO: 372 - DNA, 31 bp, Artificial Sequence; identical to SEQ ID NO: 352
  source: /note="Description of Artificial Sequence: Synthetic oligonucleotide"

SEQ ID NO: 373 - DNA, 36 bp, Artificial Sequence; identical to SEQ ID NO: 191
  source: /note="Description of Artificial Sequence: Synthetic oligonucleotide"

SEQ ID NO: 374 - DNA, 31 bp, Artificial Sequence; identical to SEQ ID NO: 354
  source: /note="Description of Artificial Sequence: Synthetic oligonucleotide"

SEQ ID NO: 375 - DNA, 36 bp, Artificial Sequence; identical to SEQ ID NO: 191
  source: /note="Description of Artificial Sequence: Synthetic oligonucleotide"

SEQ ID NO: 376 - DNA, 31 bp, Artificial Sequence; identical to SEQ ID NO: 356
  source: /note="Description of Artificial Sequence: Synthetic oligonucleotide"

SEQ ID NO: 377 - DNA, 36 bp, Artificial Sequence; identical to SEQ ID NO: 191
  source: /note="Description of Artificial Sequence: Synthetic oligonucleotide"

SEQ ID NO: 378 - DNA, 31 bp, Artificial Sequence
  source: /note="Description of Artificial Sequence: Synthetic oligonucleotide"
ttgaacttctttgttgtcttcgacatgggta

SEQ ID NO: 379 - DNA, 36 bp, Artificial Sequence; identical to SEQ ID NO: 189
  source: /note="Description of Artificial Sequence: Synthetic oligonucleotide"

SEQ ID NO: 380 - DNA, 31 bp, Artificial Sequence
  source: /note="Description of Artificial Sequence: Synthetic oligonucleotide"
aaacgtaatgcggggtgcatttcgctgattt

SEQ ID NO: 381 - DNA, 36 bp, Artificial Sequence; identical to SEQ ID NO: 189
  source: /note="Description of Artificial Sequence: Synthetic oligonucleotide"

SEQ ID NO: 382 - DNA, 31 bp, Artificial Sequence; identical to SEQ ID NO: 296
  source: /note="Description of Artificial Sequence: Synthetic oligonucleotide"

SEQ ID NO: 383 - DNA, 36 bp, Artificial Sequence; identical to SEQ ID NO: 189
  source: /note="Description of Artificial Sequence: Synthetic oligonucleotide"

SEQ ID NO: 384 - DNA, 31 bp, Artificial Sequence
  source: /note="Description of Artificial Sequence: Synthetic oligonucleotide"
tccaccaaacgtaatgcggggtgcatttcgc

SEQ ID NO: 385 - DNA, 36 bp, Artificial Sequence; identical to SEQ ID NO: 189
  source: /note="Description of Artificial Sequence: Synthetic oligonucleotide"

SEQ ID NO: 386 - DNA, 31 bp, Artificial Sequence
  source: /note="Description of Artificial Sequence: Synthetic oligonucleotide"
gggtccaccaaacgtaatgcggggtgcattt

SEQ ID NO: 387 - DNA, 36 bp, Artificial Sequence; identical to SEQ ID NO: 189
  source: /note="Description of Artificial Sequence: Synthetic oligonucleotide"

SEQ ID NO: 388 - DNA, 31 bp, Artificial Sequence
  source: /note="Description of Artificial Sequence: Synthetic oligonucleotide"
tgagggtccaccaaacgtaatgcggggtgca

SEQ ID NO: 389 - DNA, 36 bp, Artificial Sequence; identical to SEQ ID NO: 189
  source: /note="Description of Artificial Sequence: Synthetic oligonucleotide"

SEQ ID NO: 390 - DNA, 31 bp, Artificial Sequence
  source: /note="Description of Artificial Sequence: Synthetic oligonucleotide"
atctgagggtccaccaaacgtaatgcggggt

SEQ ID NO: 391 - DNA, 36 bp, Artificial Sequence; identical to SEQ ID NO: 189
  source: /note="Description of Artificial Sequence: Synthetic oligonucleotide"

SEQ ID NO: 392 - DNA, 31 bp, Artificial Sequence
  source: /note="Description of Artificial Sequence: Synthetic oligonucleotide"
tgaatctgagggtccaccaaacgtaatgcgg

SEQ ID NO: 393 - DNA, 36 bp, Artificial Sequence; identical to SEQ ID NO: 189
  source: /note="Description of Artificial Sequence: Synthetic oligonucleotide"

SEQ ID NO: 394 - DNA, 31 bp, Artificial Sequence
  source: /note="Description of Artificial Sequence: Synthetic oligonucleotide"
agttgaatctgagggtccaccaaacgtaatg

SEQ ID NO: 395 - DNA, 36 bp, Artificial Sequence; identical to SEQ ID NO: 189
  source: /note="Description of Artificial Sequence: Synthetic oligonucleotide"

SEQ ID NO: 396 - DNA, 31 bp, Artificial Sequence
  source: /note="Description of Artificial Sequence: Synthetic oligonucleotide"
gccagttgaatctgagggtccaccaaacgta

SEQ ID NO: 397 - DNA, 36 bp, Artificial Sequence; identical to SEQ ID NO: 189
  source: /note="Description of Artificial Sequence: Synthetic oligonucleotide"

SEQ ID NO: 398 - DNA, 31 bp, Artificial Sequence
  source: /note="Description of Artificial Sequence: Synthetic oligonucleotide"
actgccagttgaatctgagggtccaccaaac

SEQ ID NO: 399 - DNA, 36 bp, Artificial Sequence; identical to SEQ ID NO: 189
  source: /note="Description of Artificial Sequence: Synthetic oligonucleotide"

SEQ ID NO: 400 - DNA, 31 bp, Artificial Sequence
  source: /note="Description of Artificial Sequence: Synthetic oligonucleotide"
gttactgccagttgaatctgagggtccacca

SEQ ID NO: 401 - DNA, 31 bp, Artificial Sequence
  source: /note="Description of Artificial Sequence: Synthetic oligonucleotide"
gcagatcagggcaaacagaactttgactccc

SEQ ID NO: 402 - DNA, 31 bp, Artificial Sequence
  source: /note="Description of Artificial Sequence: Synthetic oligonucleotide"
cgatgttgaagtcttcgttgttctcggtggg

SEQ ID NO: 403 - DNA, 31 bp, Artificial Sequence
  source: /note="Description of Artificial Sequence: Synthetic oligonucleotide"
gcaacttcccgcggtcagcatcgagatccgt

SEQ ID NO: 404 - DNA, 31 bp, Artificial Sequence
  source: /note="Description of Artificial Sequence: Synthetic oligonucleotide"
tgcagccagctttccgggcattggcttccat

SEQ ID NO: 405 - DNA, 31 bp, Artificial Sequence
  source: /note="Description of Artificial Sequence: Synthetic oligonucleotide"
tgaacttcttcatcttgggcgtgcacttgat

SEQ ID NO: 406 - DNA, 31 bp, Artificial Sequence
  source: /note="Description of Artificial Sequence: Synthetic oligonucleotide"
gaatgtcgacgatcgcctcgcctatgccgcc

SEQ ID NO: 407 - DNA, 31 bp, Artificial Sequence
  source: /note="Description of Artificial Sequence: Synthetic oligonucleotide"
atgaactgctccatgggctccaagtccttga

SEQ ID NO: 408 - DNA, 31 bp, Artificial Sequence
  source: /note="Description of Artificial Sequence: Synthetic oligonucleotide"
gcagccagttgtgcagtccacacacagatcg

SEQ ID NO: 409 - DNA, 31 bp, Artificial Sequence
  source: /note="Description of Artificial Sequence: Synthetic oligonucleotide"
gcgttgcggcagccacttcttgagcaggtca

SEQ ID NO: 410 - DNA, 31 bp, Artificial Sequence
  source: /note="Description of Artificial Sequence: Synthetic oligonucleotide"
tgtccacctggccctggatcttgctggcaaa

SEQ ID NO: 411 - DNA, 31 bp, Artificial Sequence
  source: /note="Description of Artificial Sequence: Synthetic oligonucleotide"
ggtaatgcctggcttgtcgacgcatagtctg

SEQ ID NO: 412 - DNA, 31 bp, Artificial Sequence
  source: /note="Description of Artificial Sequence: Synthetic oligonucleotide"
gggaaccttggccgttataaagtctgaccag

SEQ ID NO: 413 - DNA, 31 bp, Artificial Sequence
  source: /note="Description of Artificial Sequence: Synthetic oligonucleotide"
tataatggtgaatatcttcaaatgatttagt

SEQ ID NO: 414 - DNA, 31 bp, Artificial Sequence
  source: /note="Description of Artificial Sequence: Synthetic oligonucleotide"
atgtatagaaggcatcatcaacaccctgtct

SEQ ID NO: 415 - DNA, 31 bp, Artificial Sequence
  source: /note="Description of Artificial Sequence: Synthetic oligonucleotide"
ggttaaaaatttacagattgtgctgagcttg

SEQ ID NO: 416 - DNA, 31 bp, Artificial Sequence
  source: /note="Description of Artificial Sequence: Synthetic oligonucleotide"
gtagatgctctttcctcctgtgccatctccc

SEQ ID NO: 417 - DNA, 31 bp, Artificial Sequence
  source: /note="Description of Artificial Sequence: Synthetic oligonucleotide"
cagtttgaagttctcatcggggaagcgctca

SEQ ID NO: 418 - DNA, 31 bp, Artificial Sequence
  source: /note="Description of Artificial Sequence: Synthetic oligonucleotide"
cagtgttggtaggagtttgttacaaaagtga

SEQ ID NO: 419 - DNA, 31 bp, Artificial Sequence
  source: /note="Description of Artificial Sequence: Synthetic oligonucleotide"
cttggccaagtctgttatgttcacctgaaaa

SEQ ID NO: 420 - DNA, 31 bp, Artificial Sequence
  source: /note="Description of Artificial Sequence: Synthetic oligonucleotide"
caaaatgtactcagcttcaatcacaaatacg

SEQ ID NO: 421 - DNA, 31 bp, Artificial Sequence
  source: /note="Description of Artificial Sequence: Synthetic oligonucleotide"
ggttatagcttgacaagcaattaactttaaa

SEQ ID NO: 422 - DNA, 31 bp, Artificial Sequence
  source: /note="Description of Artificial Sequence: Synthetic oligonucleotide"
atgataatgcaatagcaggacaggatgacaa

SEQ ID NO: 423 - DNA, 31 bp, Artificial Sequence; identical to SEQ ID NO: 411
  source: /note="Description of Artificial Sequence: Synthetic oligonucleotide"

SEQ ID NO: 424 - DNA, 31 bp, Artificial Sequence; identical to SEQ ID NO: 412
  source: /note="Description of Artificial Sequence: Synthetic oligonucleotide"

SEQ ID NO: 425 - DNA, 50 bp, Artificial Sequence
  source: /note="Description of Artificial Sequence: Synthetic oligonucleotide"
catcctgcggcctctactctgcattcaattacatactgacacattcggca

SEQ ID NO: 426 - DNA, 50 bp, Artificial Sequence
  source: /note="Description of Artificial Sequence: Synthetic oligonucleotide"
accatcctgcggcctctactctgcattcaattacatactgacacattcgg

SEQ ID NO: 427 - DNA, 50 bp, Artificial Sequence
  source: /note="Description of Artificial Sequence: Synthetic oligonucleotide"
aaaccatcctgcggcctctactctgcattcaattacatactgacacattc

SEQ ID NO: 428 - DNA, 50 bp, Artificial Sequence
  source: /note="Description of Artificial Sequence: Synthetic oligonucleotide"
ctaaaccatcctgcggcctctactctgcattcaattacatactgacacat

SEQ ID NO: 429 - DNA, 50 bp, Artificial Sequence
  source: /note="Description of Artificial Sequence: Synthetic oligonucleotide"
ttctaaaccatcctgcggcctctactctgcattcaattacatactgacac

SEQ ID NO: 430 - DNA, 50 bp, Artificial Sequence
  source: /note="Description of Artificial Sequence: Synthetic oligonucleotide"
tgttctaaaccatcctgcggcctctactctgcattcaattacatactgac

SEQ ID NO: 431 - DNA, 50 bp, Artificial Sequence
  source: /note="Description of Artificial Sequence: Synthetic oligonucleotide"
aatgttctaaaccatcctgcggcctctactctgcattcaattacatactg

SEQ ID NO: 432 - DNA, 50 bp, Artificial Sequence
  source: /note="Description of Artificial Sequence: Synthetic oligonucleotide"
agaatgttctaaaccatcctgcggcctctactctgcattcaattacatac

SEQ ID NO: 433 - DNA, 50 bp, Artificial Sequence
  source: /note="Description of Artificial Sequence: Synthetic oligonucleotide"
atagaatgttctaaaccatcctgcggcctctactctgcattcaattacat

SEQ ID NO: 434 - DNA, 50 bp, Artificial Sequence
  source: /note="Description of Artificial Sequence: Synthetic oligonucleotide"
ccatagaatgttctaaaccatcctgcggcctctactctgcattcaattac

SEQ ID NO: 435 - DNA, 50 bp, Artificial Sequence
  source: /note="Description of Artificial Sequence: Synthetic oligonucleotide"
ttccatagaatgttctaaaccatcctgcggcctctactctgcattcaatt

SEQ ID NO: 436 - DNA, 50 bp, Artificial Sequence
  source: /note="Description of Artificial Sequence: Synthetic oligonucleotide"
ctttccatagaatgttctaaaccatcctgcggcctctactctgcattcaa

SEQ ID NO: 437 - DNA, 50 bp, Artificial Sequence
  source: /note="Description of Artificial Sequence: Synthetic oligonucleotide"
ctctttccatagaatgttctaaaccatcctgcggcctctactctgcattc

SEQ ID NO: 438 - DNA, 50 bp, Artificial Sequence
  source: /note="Description of Artificial Sequence: Synthetic oligonucleotide"
atctctttccatagaatgttctaaaccatcctgcggcctctactctgcat

SEQ ID NO: 439 - DNA, 50 bp, Artificial Sequence
  source: /note="Description of Artificial Sequence: Synthetic oligonucleotide"
gaatctctttccatagaatgttctaaaccatcctgcggcctctactctgc

SEQ ID NO: 440 - DNA, 50 bp, Artificial Sequence
  source: /note="Description of Artificial Sequence: Synthetic oligonucleotide"
tggaatctctttccatagaatgttctaaaccatcctgcggcctctactct

SEQ ID NO: 441 - DNA, 50 bp, Artificial Sequence
  source: /note="Description of Artificial Sequence: Synthetic oligonucleotide"
actggaatctctttccatagaatgttctaaaccatcctgcggcctctact

SEQ ID NO: 442 - DNA, 50 bp, Artificial Sequence
  source: /note="Description of Artificial Sequence: Synthetic oligonucleotide"
gaactggaatctctttccatagaatgttctaaaccatcctgcggcctcta

SEQ ID NO: 443 - DNA, 50 bp, Artificial Sequence
  source: /note="Description of Artificial Sequence: Synthetic oligonucleotide"
tggaactggaatctctttccatagaatgttctaaaccatcctgcggcctc

SEQ ID NO: 444 - DNA, 50 bp, Artificial Sequence
  source: /note="Description of Artificial Sequence: Synthetic oligonucleotide"
cctggaactggaatctctttccatagaatgttctaaaccatcctgcggcc

SEQ ID NO: 445 - DNA, 50 bp, Artificial Sequence
  source: /note="Description of Artificial Sequence: Synthetic oligonucleotide"
ttcctggaactggaatctctttccatagaatgttctaaaccatcctgcgg

SEQ ID NO: 446 - DNA, 50 bp, Artificial Sequence
  source: /note="Description of Artificial Sequence: Synthetic oligonucleotide"
ggttcctggaactggaatctctttccatagaatgttctaaaccatcctgc

SEQ ID NO: 447 - DNA, 28 bp, Artificial Sequence
  source: /note="Description of Artificial Sequence: Synthetic oligonucleotide"
acccaggaatctcaggaatgtcgacgat

SEQ ID NO: 448 - DNA, 30 bp, Artificial Sequence
  source: /note="Description of Artificial Sequence: Synthetic oligonucleotide"
gggcattggcttccatctctttgagcacct

SEQ ID NO: 449 - DNA, 28 bp, Artificial Sequence
  source: /note="Description of Artificial Sequence: Synthetic oligonucleotide"
acccaggaatctcaggaatgtcgacgat

SEQ ID NO: 450 - DNA, 48 bp, Artificial Sequence
  source: /note="Description of Artificial Sequence: Synthetic oligonucleotide"
aaagttctgtttgccctgatcctcgaggatcagggcaaacagaacttt

SEQ ID NO: 451 - protein, 45 aa, Unknown
  source: /note="Description of Unknown: Candidatus Poribacteria bacterium sequence"
RDMATSAHTTIDKETKRTKENHLINLEVVRIEDNRYLKGSVEMIN

SEQ ID NO: 452 - protein, 44 aa, Unknown
  source: /note="Description of Unknown: Methanomicrobia archaeon sequence"
DQVRTSAHNKINRATGRVEKDLLFSYELGANTVPLEGTIERVNP

SEQ ID NO: 453 - protein, 44 aa, Unknown
  source: /note="Description of Unknown: Methanophagales archaeon sequence"
DMVRTSTHNKISRATGRVEKDHLFSYELGANTTPFEGMIEPVNH

SEQ ID NO: 454 - protein, 43 aa, Unknown
  source: /note="Description of Unknown: Deltaproteobacteria bacterium sequence"
GTTRVSLHNRVDPTTGRVPEETFFSFEVGSAEKFTGRIERSGP

SEQ ID NO: 455 - protein, 43 aa, Unknown
  source: /note="Description of Unknown: Firmicutes bacterium sequence"
EPIRISTHNRIDPATGRVPKDLLFTFEMGSPAVFRGYIERIGI

SEQ ID NO: 456 - protein, 44 aa, Unknown
  source: /note="Description of Unknown: Ktedonosporobacter rubrisoli sequence"
LQTFLYTQARLDRPTRTAVPGALYSSEFGLREITFKGSVTGWLE

SEQ ID NO: 457 - protein, 44 aa, Unknown
  source: /note="Description of Unknown: Chloroflexi bacterium sequence"
NQKDVYTQVRLDRPTRTAVEGALYTSEFGTRGLTFHGDITGSLT

SEQ ID NO: 458 - protein, 44 aa, Unknown
  source: /note="Description of Unknown: ANME-2 cluster archaeon sequence"
LFLNTRTGTKIDRRTGTVQEDHLFTTESGIKGITLTSKIYGRGN

SEQ ID NO: 459 - protein, 44 aa, Unknown
  source: /note="Description of Unknown: Anaerolineaceae bacterium sequence"
YGQSIRSNNRIDPKTRTAANDHLFFTECVDPDTYFIGEIRSSSN

SEQ ID NO: 460 - protein, 44 aa, Unknown
  source: /note="Description of Unknown: Ornatilinea apprima sequence"
YGRLLRTGIGIDRKLRVVVPDRLFTNECVGTKIPFTGRIIGEFP

SEQ ID NO: 461 - protein, 44 aa, Unknown
  source: /note="Description of Unknown: HreCas7-11 sequence"
EIAVSRVVNRVDPNSGKAKDFFRVWEIDHKLCPNFLGKMSISLS

SEQ ID NO: 462 - protein, 44 aa, Unknown
  source: /note="Description of Unknown: CmaCas7-11 sequence"
DIVQKRILNRVDQTCGKAKDFFKVCEVDHIACPTLNGIIRINDE

SEQ ID NO: 463 - protein, 42 aa, Unknown
  source: /note="Description of Unknown: HvmCas7-11 sequence"
ETAIERIVNRVDPSSGKAKDYMRIWEIDPLVCSQFNGIITIN

SEQ ID NO: 464 - protein, 42 aa, Unknown
  source: /note="Description of Unknown: SmCas7-11 sequence"
EIGSRRTINRVDDETGKAHDFFSIWEVDAVREFQGEIVLAAD

SEQ ID NO: 465 - protein, 42 aa, Unknown
  source: /note="Description of Unknown: OmCas7-11 sequence"
EIGRLRTLNRIDRLTTKAQDFFRIYEVDQVRDFFGTITLAGD

SEQ ID NO: 466 - protein, 44 aa, Unknown
  source: /note="Description of Unknown: DisCas7-11 sequence"
AIGSQRVLNRVDFKSGKAHDFFKAYEVDHTRFPRFEGEITIDNK

SEQ ID NO: 467 - protein, 44 aa, Unknown
  source: /note="Description of Unknown: DsbaCas7-11 sequence"
EIAVRRVVNRVDYASGKAHDFFRIFEVDHIAFPCFHGEIAFGEN

SEQ ID NO: 468 - protein, 44 aa, Unknown
  source: /note="Description of Unknown: SstCas7-11 sequence"
DIGTQRTLNRVDYATGKAHDFFKVWEIDHSLLSVFQGKISIADN

SEQ ID NO: 469 - protein, 44 aa, Unknown
  source: /note="Description of Unknown: CsbCas7-11 sequence"
DIASGRILNRVDFDTGKAKDYFRTWEADYETYGTYTGRITLRNE

SEQ ID NO: 470 - protein, 44 aa, Unknown
  source: /note="Description of Unknown: CjcCas7-11 sequence"
DIASERILNRVDYTTGKAHDYFKVWEVDDDQWWQFTGTITMHDD

SEQ ID NO: 471 - protein, 44 aa, Unknown
  source: /note="Description of Unknown: CbfCas7-11 sequence"
DVCKERVLNRVDFRTGKAQDYFRVFEIDHEDWGVYTGEITITEP

SEQ ID NO: 472 - protein, 44 aa, Unknown
  source: /note="Description of Unknown: HvsCas7-11 sequence"
ELAPKRALNRIEQYTGKAQDYFTVYEALNKEFWTFKGRIRIKED

SEQ ID NO: 473 - protein, 44 aa, Unknown
  source: /note="Description of Unknown: HsmCas7-11 sequence"
EIGIRRILNRVDFTTGKAQDYFYVWEVEHSMCPKFQGTVKINED

SEQ ID NO: 474 - protein, 42 aa, Unknown
  source: /note="Description of Unknown: FmCas7-11 sequence"
DIAQKRTSNRVDFFSKKAHDHYGVWEVTAVKNLLGYIYISDA

SEQ ID NO: 475 - protein, 44 aa, Unknown
  source: /note="Description of Unknown: DpbaCas7-11 sequence"
QLIRPRILNRMDPGTSKARDYFRVFEIENQLCSQFRGWIWLSGD

SEQ ID NO: 476 - protein, 30 aa, Unknown
  source: /note="Description of Unknown: WmCas7x3 sequence"
QRITPDAPDADPYWQADIALDADGRPYLPG

SEQ ID NO: 477 - protein, 35 aa, Unknown
  source: /note="Description of Unknown: NisCas7x3 sequence"
EEMDKQSGESVDKKQNNSWIQAIALDLNKKPYIPG

SEQ ID NO: 478 - protein, 28 aa, Unknown
  source: /note="Description of Unknown: GwCas7x3 sequence"
EKERDENKETRWLEAVALDHKGQPYIPG

SEQ ID NO: 479 - protein, 32 aa, Unknown
  source: /note="Description of Unknown: HvmCas7x3 sequence"
VTRPELTVADRDELVDINAVVTDYTGKPYLPG

SEQ ID NO: 480 - protein, 35 aa, Unknown
  source: /note="Description of Unknown: DsbCas7x3 sequence"
TDRPGLEIEQKDGSKVKAEINAFIKDSNGKPYLPG

SEQ ID NO: 481 - protein, 32 aa, Unknown
  source: /note="Description of Unknown: GamCas7x3 sequence"
IPVTIKDTQGKNREVEVNSVITGKAALPIIPG

SEQ ID NO: 482 - protein, 31 aa, Unknown
  source: /note="Description of Unknown: DesCas7x3 sequence"
VEHDLIKNDDGTPVQINALITGAGGLPIIPG

SEQ ID NO: 483 - protein, 32 aa, Unknown
  source: /note="Description of Unknown: GabCas7x3 sequence"
AEIEINDSQGDRRQVQANAIIRGKDDKPIIPG

SEQ ID NO: 484 - protein, 31 aa, Unknown
  source: /note="Description of Unknown: MetCas7x3 sequence"
CEHDDVKNNDGEPVKINACIKGSKGRPIIPG

SEQ ID NO: 485 - protein, 31 aa, Unknown
  source: /note="Description of Unknown: MebCas7x3 sequence"
CYRPELTNADQKPVDINACIKGANNLPIIPG

SEQ ID NO: 486 - protein, 29 aa, Unknown
  source: /note="Description of Unknown: GwCas7-11 sequence"
EGQKQTDDQAESLHLRTLRDGHGRFRIPF

SEQ ID NO: 487 - protein, 21 aa, Unknown
  source: /note="Description of Unknown: HreCas7-11 sequence"
SEGQTSQAIILCPDGSYRLPR

SEQ ID NO: 488 - protein, 21 aa, Unknown
  source: /note="Description of Unknown: CmaCas7-11 sequence"
KTSHTRSTIFLNMNGQFCIPR

SEQ ID NO: 489 - protein, 21 aa, Unknown
  source: /note="Description of Unknown: HvmCas7-11 sequence"
QEGQTSATILLNRDGYFRLPR

SEQ ID NO: 490 - protein, 23 aa, Unknown
  source: /note="Description of Unknown: SmCas7-11 sequence"
PIDDDQTSSRTLVDRDGRYRLPR

SEQ ID NO: 491 - protein, 22 aa, Unknown
  source: /note="Description of Unknown: OmCas7-11 sequence"
GSHDHTSRKILLTRDFYYRLPR

SEQ ID NO: 492 - protein, 22 aa, Unknown
  source: /note="Description of Unknown: DisCas7-11 sequence"
EDAKQTDLQVLLTPDNKYRLPR

SEQ ID NO: 493 - protein, 22 aa, Unknown
  source: /note="Description of Unknown: DsbaCas7-11 sequence"
KEKKQTDLMLLLDGQNHYRIPR

SEQ ID NO: 494 - protein, 22 aa, Unknown
  source: /note="Description of Unknown: SstCas7-11 sequence"
EDAKHTNLKVLLDRQNRYRLPR

SEQ ID NO: 495 - protein, 22 aa, Unknown
  source: /note="Description of Unknown: SybCas7-11 sequence"
GAGGHTDLSILLGKDGHYRVPR

SEQ ID NO: 496 - protein, 37 aa, Unknown
  source: /note="Description of Unknown: CsbCas7-11 sequence"
SDSIPGKEKKSEDSLVINEHTSFNILLDKENRYRIPR

SEQ ID NO: 497 - protein, 43 aa, Unknown
  source: /note="Description of Unknown: CjcCas7-11 sequence"
FDSTQDDLDLVPDIVNTDEKLEANEQTSFRILMDKKGRYRIPR

SEQ ID NO: 498 - protein, 25 aa, Unknown
  source: /note="Description of Unknown: CbfCas7-11 sequence"
EQTEEVEHTSLRLVMDKKGRFRIPR

SEQ ID NO: 499 - protein, 21 aa, Unknown
  source: /note="Description of Unknown: HvsCas7-11 sequence"
DEEKAEGAILLTPDNRFRLPR

SEQ ID NO: 500 - protein, 22 aa, Unknown
  source: /note="Description of Unknown: HsmCas7-11 sequence"
KTEEQIDMQILLTKDGRYRLPR

SEQ ID NO: 501 - protein, 22 aa, Unknown
  source: /note="Description of Unknown: FmCas7-11 sequence"
QAGKQTSMPTLQDSNDHFRLPR

SEQ ID NO: 502 - protein, 22 aa, Unknown
  source: /note="Description of Unknown: DpbaCas7-11 sequence"
ATETHTDLPILLTSDRHFRIPR

SEQ ID NO: 503 - protein, 33 aa, Unknown
  source: /note="Description of Unknown: WmCas7x3 sequence"
HRKPQDNAPDGTPRQRGDRALLPGASLRGRLRS

SEQ ID NO: 504 - protein, 34 aa, Unknown
  source: /note="Description of Unknown: NisCas7x3 sequence"
KKDEAKNEADAKPRTNHQGQVILPASSLRGRLRA

SEQ ID NO: 505 - protein, 30 aa, Unknown
  source: /note="Description of Unknown: GwCas7x3 sequence"
KADDADAVPRRTHDDKIVLPASSLRGRLRT

SEQ ID NO: 506 - protein, 34 aa, Unknown
  source: /note="Description of Unknown: HvmCas7x3 sequence"
KKKRRSNTPNLRPLRDAIGRPCLPESSVRGALRA

SEQ ID NO: 507 - protein, 32 aa, Unknown
  source: /note="Description of Unknown: DsbCas7x3 sequence"
KKRKEDIDHQPLRDSAGNARLPAKSIRGAMRS

SEQ ID NO: 508 - protein, 34 aa, Unknown
  source: /note="Description of Unknown: GamCas7x3 sequence"
DKCKAEDTPDIYPLEEKNGVPAFPVRSFRGAIRS

SEQ ID NO: 509 - protein, 34 aa, Unknown
  source: /note="Description of Unknown: DesCas7x3 sequence"
NTPDITQAPDMVPLVDEDGNPMLPASSFRGALRA

SEQ ID NO: 510 - protein, 34 aa, Unknown
  source: /note="Description of Unknown: GabCas7x3 sequence"
SKGDGDQPAVHQPLTDRSNNPILPARSFRGAIRA

SEQ ID NO: 511 - protein, 34 aa, Unknown
  source: /note="Description of Unknown: MetCas7x3 sequence"
LSSNENAKTDHYPLLDKNRNPYLPVSSFRGVLRS

SEQ ID NO: 512 - protein, 34 aa, Unknown
  source: /note="Description of Unknown: MebCas7x3 sequence"
LEADPKTKIDHYPLLDNHKKPRLPSASIRGVLRS

SEQ ID NO: 513 - protein, 48 aa, Unknown
  source: /note="Description of Unknown: GwCas7-11 sequence"
ESDAPDNVAYKKPVVQYDETGRLRTTDPGPVEMLTCLKGEGVRGVVAY

SEQ ID NO: 514 - protein, 42 aa, Unknown
  source: /note="Description of Unknown: HreCas7-11 sequence"
DHDNKDAVMVQKTVLFVDESGNYSQMPHHFLKGSGIRGACRF

SEQ ID NO: 515 - protein, 47 aa, Unknown
  source: /note="Description of Unknown: CmaCas7-11 sequence"
DNRNPDAVMVKKTILVYEQDSSTHKNVPKEVPKYFIKSETIRGLLRS

SEQ ID NO: 516 - protein, 44 aa, Unknown
  source: /note="Description of Unknown: HvmCas7-11 sequence"
DPRNTDAIMVRKTVFCPDPNAKNRPAPATVYMIKGESIRGILRS

SEQ ID NO: 517 - protein, 37 aa, Unknown
  source: /note="Description of Unknown: SmCas7-11 sequence"
NSDTADIISFRRTVVDNGEVLREPVLRGEGLRGLLRT

SEQ ID NO: 518 - protein, 37 aa, Unknown
  source: /note="Description of Unknown: OmCas7-11 sequence"
RHEEDSVYFQKRIFTSDGRVVLVPALRGEGLRGLLRT

SEQ ID NO: 519 - protein, 37 aa, Unknown
  source: /note="Description of Unknown: DisCas7-11 sequence"
DKRGTDVVTFVKYKAEGEEAKPVCAYKAESFRGVIRS

SEQ ID NO: 520 - protein, 35 aa, Unknown
  source: /note="Description of Unknown: DsbaCas7-11 sequence"
TEDVADIVSFKKYTQGGEKIIYAYKSESFRGVVRT

SEQ ID NO: 521 - protein, 35 aa, Unknown
  source: /note="Description of Unknown: SstCas7-11 sequence"
EKDGSDIVSFRKYADDSGKEVYAYKAESFRGVVRA

SEQ ID NO: 522 - protein, 39 aa, Unknown
  source: /note="Description of Unknown: SybCas7-11 sequence"
ERIGFDNIAYEKRRYNGETNTTESIPAVKGETFRGIVRT

SEQ ID NO: 523 - protein, 41 aa, Unknown
  source: /note="Description of Unknown: CsbCas7-11 sequence"
EPGNRDAIAYKKRVYNDGNNAIEPEPRFAVKSETHRGIFRT

SEQ ID NO: 524 - protein, 37 aa, Unknown
  source: /note="Description of Unknown: CjcCas7-11 sequence"
NKDNIDCIAYEKRKWENGGIKFVPTIKGETIRGIVRM

SEQ ID NO: 525 - protein, 37 aa, Unknown
  source: /note="Description of Unknown: CbfCas7-11 sequence"
DPNNVDAIVFEKMKLDGDQVKYLPAIKGETIRGIVRT

SEQ ID NO: 526 - protein, 37 aa, Unknown
  source: /note="Description of Unknown: HvsCas7-11 sequence"
EGKAPDAVFFKKYVFENGKIEEKPCFKAESIRGIFRT

SEQ ID NO: 527 - protein, 35 aa, Unknown
  source: /note="Description of Unknown: HsmCas7-11 sequence"
DSSNTDLVTFKKYKLEESKEVFAIKGESIRGVFRT

SEQ ID NO: 528 - protein, 38 aa, Unknown
  source: /note="Description of Unknown: FmCas7-11 sequence"
HGNTDSVFYKKPILKSGEKEPSYQWAIKSDTVRGLIRS

SEQ ID NO: 529 - protein, 34 aa, Unknown
  source: /note="Description of Unknown: DpbaCas7-11 sequence"
RNESDAVFYQKSVAGEKGPVYALKGEGLRGIVSS

SEQ ID NO: 530 - protein, 43 aa, Unknown
  source: /note="Description of Unknown: WmCas7x3 sequence"
PATLVDHDMLAIDRFTGGGKDGAKFKLRYAECPTLEGQLSLDL

SEQ ID NO: 531 - protein, 43 aa, Unknown
  source: /note="Description of Unknown: NisCas7x3 sequence"
LATLTRHEMVAIDRFTGGGKEGAKFNVDYIECPTLTGAIYLDL

SEQ ID NO: 532 - protein, 43 aa, Unknown
  source: /note="Description of Unknown: GwCas7x3 sequence"
SIKTRRHEMLAIDRFTGGGKDGAKFNVDYVECPTLAGKLSLDL

SEQ ID NO: 533 - protein, 43 aa, Unknown
  source: /note="Description of Unknown: HvmCas7x3 sequence"
EDCDNIQEFVAIDRFTGGAKDKAKFNAEYIGSPRFTGTIALDK

SEQ ID NO: 534 - protein, 43 aa, Unknown
  source: /note="Description of Unknown: DsbCas7x3 sequence"
TRQETVQDFVAIDRFHGGGKETAKFDASFSWRPQYSILMHIPS

SEQ ID NO: 535 - protein, 43 aa, Unknown
  source: /note="Description of Unknown: GamCas7x3 sequence"
LKPFIIQEFVAIDRFHGGGKDEAKFNAAHYQAPVFKGKVRVSQ

SEQ ID NO: 536 - protein, 43 aa, Unknown
  source: /note="Description of Unknown: DesCas7x3 sequence"
FRREQEQTFVAIDRFHGGCKEGALYTIRHAESPRFEGHLVIDP

SEQ ID NO: 537 - protein, 43 aa, Unknown
  source: /note="Description of Unknown: GabCas7x3 sequence"
YRPAKTQQFVAIDRFHGGGKDGALFSIKYFERPVLKGGISLKL

SEQ ID NO: 538 - protein, 43 aa, Unknown
  source: /note="Description of Unknown: MetCas7x3 sequence"
KSKKTKQDFVAIDRFHGGGKDGAKFDATHFERPEFEGAISFSP

SEQ ID NO: 539 - protein, 43 aa, Unknown
  source: /note="Description of Unknown: MebCas7x3 sequence"
ANELKTQEFIAIDRFHGGGKDGAKFNAKHSERPYFQGRITLSP

SEQ ID NO: 540 - protein, 47 aa, Unknown
  source: /note="Description of Unknown: GwCas7-11 sequence"
TPHAMRSDRVALDVFGGAMPEAKFDDRPLAASPGKPLNFKSTIWYRE

SEQ ID NO: 541 - protein, 48 aa, Unknown
  source: /note="Description of Unknown: HreCas7-11 sequence"
EVEAIKCDHVAIDRFHGGTVHRMKYDDYPLPGSPNRPLRIKGNIWVKR

SEQ ID NO: 542 - protein, 48 aa, Unknown
  source: /note="Description of Unknown: CmaCas7-11 sequence"
NVSDCCIDHVAIDRFTGGGVEKMKFNDYPLSASPKNCLNLKGSIWITS

SEQ ID NO: 543 - protein, 48 aa, Unknown
  source: /note="Description of Unknown: HvmCas7-11 sequence"
SVSDKKMDHVAIDRFTGGGVDQMKFDDYPLPGCPAQPLILEGKFWVKD

SEQ ID NO: 544 - protein, 46 aa, Unknown
  source: /note="Description of Unknown: SmCas7-11 sequence"
TVADKRLDHVAIDRFDQSVVEKYDDRPLVGSPKQPLVFKGCFWVQT

SEQ ID NO: 545 - protein, 46 aa, Unknown
  source: /note="Description of Unknown: OmCas7-11 sequence"
TWNDKKIDHVSCSRFDASVVNKFDDRSLVGSPDSPLHFEGTFWLHR

SEQ ID NO: 546 - protein, 48 aa, Unknown
  source: /note="Description of Unknown: DisCas7-11 sequence"
DPEPVTFDHVAIDRFTGGAADKKKFDDSPLPGSPARPLMLKGSFWIRR

SEQ ID NO: 547 - protein, 48 aa, Unknown
  source: /note="Description of Unknown: DsbaCas7-11 sequence"
EPEPRRFDHVAIDRFTGGAVNQKKFDDRSLVPGKEGFMTLIGCFWMRK

SEQ ID NO: 548 - protein, 48 aa, Unknown
  source: /note="Description of Unknown: SstCas7-11 sequence"
QPEPMIFDHVAIDRFTGGAVDKKKFDDCSLPGTPGHPLTLKGCFWIRK

SEQ ID NO: 549 - protein, 48 aa, Unknown
  source: /note="Description of Unknown: SybCas7-11 sequence"
AWTRKHLDHVAIDRFHGGAEENMKFDTYALAASPTNPLRMKGLIWVRS

SEQ ID NO: 550 - protein, 48 aa, Unknown
  source: /note="Description of Unknown: CsbCas7-11 sequence"
EKLEKHIDHVAIDRFTGGALDKAKFDTYPLAGSPKKPLKLKGRFWIKK

SEQ ID NO: 551 - protein, 48 aa, Unknown
  source: /note="Description of Unknown: CjcCas7-11 sequence"
SYKKKLIDHVAIDRFHGGAEDKMKFNTLPLAGSFEKPIILKGRFWIKK

SEQ ID NO: 552 - protein, 48 aa, Unknown
  source: /note="Description of Unknown: CbfCas7-11 sequence"
KDIAKKIDHVAIDRFTGGARDQMKFDTLPLIGSPERPLRLKGLFWMRR

SEQ ID NO: 553 - protein, 48 aa, Unknown
  source: /note="Description of Unknown: HvsCas7-11 sequence"
GQEEKFFDHVAIDRFLGGAKEKYKFDDKPIIGAPDTPIVLEGKIWVKK

SEQ ID NO: 554 - protein, 48 aa, Unknown
  source: /note="Description of Unknown: HsmCas7-11 sequence"
DSAPKRLDHVAIDRFTGGAKEQAKFDDSPLIGSPDSPLEFTGIVWVRD

SEQ ID NO: 555 - protein, 48 aa, Unknown
  source: /note="Description of Unknown: FmCas7-11 sequence"
EIKTYRMDHVAIDRISGGAVDQCKYDDEPLVGTSKHPLVFKGMFWINR

SEQ ID NO: 556 - protein, 45 aa, Unknown
  source: /note="Description of Unknown: DpbaCas7-11 sequence"
EVREKLFDHVSIDRFTGGAANKLKFDDKPLVGNPLVFQGVFWVHQ

SEQ ID NO: 557 - protein, 48 aa, Unknown
  source: /note="Description of Unknown: WmCas7x3 sequence"
PVAGFALQNQPAIPATSLRGLLSSLFESISGSNLRVLHPTPYSIRKTT

SEQ ID NO: 558 - protein, 48 aa, Unknown
  source: /note="Description of Unknown: NisCas7x3 sequence"
EARPFKLNGKHAIPATSLRGMLSSLFESVSNSNFRVLHPEHYSVRKSL

SEQ ID NO: 559 - protein, 48 aa, Unknown
  source: /note="Description of Unknown: GwCas7x3 sequence"
SLHPFKLNNGLAIPATSLRGMISSLFESVSNSNFRVLDEKTYSMRKTM

SEQ ID NO: 560 - protein, 48 aa, Unknown
  source: /note="Description of Unknown: HvmCas7x3 sequence"
EILPFTLGGKPAIPATSLRGMLSSIAEAASNSSLRVLEDKTLSYRKSM

SEQ ID NO: 561 - protein, 48 aa, Unknown
  source: /note="Description of Unknown: DsbCas7x3 sequence"
QVDHYTENGEIAIPATTLRGLLSSLSEAASNSSMRVLDDGMMSYRQPV

SEQ ID NO: 562 - protein, 48 aa, Unknown
  source: /note="Description of Unknown: GamCas7x3 sequence"
LRHPYQLDGEPAIPSTSLRGLISTMTEAAANCAMRVLDSEIISYRKPM

SEQ ID NO: 563 - protein, 48 aa, Unknown
  source: /note="Description of Unknown: DesCas7x3 sequence"
RIENYRLGNRIAIPAASLRGMLSSLAEAASNSAMRVLHQGILSYRKKA

SEQ ID NO: 564 - protein, 48 aa, Unknown
  source: /note="Description of Unknown: GabCas7x3 sequence"
LKEHYQLNNKLAIPATSLRGLISSLAEAASNSALRVLDNGVLSYRKPA

SEQ ID NO: 565 - protein, 48 aa, Unknown
  source: /note="Description of Unknown: MetCas7x3 sequence"
EINNYRLNGELAIPATSLRGMISSLAEAASNSAMRVLDNGLLSYRKTA

SEQ ID NO: 566 - protein, 48 aa, Unknown
  source: /note="Description of Unknown: MebCas7x3 sequence"
ELDNYRLNGQLAIPATSLRGMISSLAEAASNSAMRVLDNGLLSYRKDA

SEQ ID NO: 567 - protein, 48 aa, Unknown
  source: /note="Description of Unknown: GwCas7-11 sequence"
TQRFHQINDEIGLPGASLRGMVLSNYQILTNSCYRNLKATEEITRRMP

SEQ ID NO: 568 - protein, 48 aa, Unknown
  source: /note="Description of Unknown: HreCas7-11 sequence"
NYRFFRINDELAIPGSELRGMVSSVYEALTNSCFRIMEEGRYLSRRMG

SEQ ID NO: 569 - protein, 48 aa, Unknown
  source: /note="Description of Unknown: CmaCas7-11 sequence"
NYAFFRINDHIAIPGASIRGMISSVFETLTHSCFRVMDDKKYLTRRVI

SEQ ID NO: 570 - protein, 48 aa, Unknown
  source: /note="Description of Unknown: HvmCas7-11 sequence"
NYGFFRINGNVAIPGSSIRGMISSVFEALTNSCFRVFDQERYLSRSEK

SEQ ID NO: 571 - protein, 48 aa, Unknown
  source: /note="Description of Unknown: SmCas7-11 sequence"
NFPFFKINDEIMLPGAPLWAAVSQVYEALTNSCFRVMKQKRFLSWRME

SEQ ID NO: 572 - protein, 48 aa, Unknown
  source: /note="Description of Unknown: OmCas7-11 sequence"
EYPSFRLNNTPMIPGAGLRAAVSQVYEVLTNSCIRIMDQGQTLSWRMS

SEQ ID NO: 573 - protein, 48 aa, Unknown
  source: /note="Description of Unknown: DisCas7-11 sequence"
SYAFFRLHKQIMIPGSELRGMVSSVYETVTNSCFRIFDETKRLSWRMD

SEQ ID NO: 574 - protein, 48 aa, Unknown
  source: /note="Description of Unknown: DsbaCas7-11 sequence"
SYRFFTLNRVPMIPGSEIRGMISSVFEALSNSCFRIFDEKYRLSWRMD

SEQ ID NO: 575 - protein, 48 aa, Unknown
  source: /note="Description of Unknown: SstCas7-11 sequence"
SYAFFSVNGDIMLPGSEIRGMLSSVYEALTNSCFRVFDEGYRLSWRME

SEQ ID NO: 576 - protein, 48 aa, Unknown
  source: /note="Description of Unknown: SybCas7-11 sequence"
MCKFFSVAGKPMIPGSEIRGMISSVYEALTNSCFRVFDEEKYLTRRVQ

SEQ ID NO: 577 - protein, 48 aa, Unknown
  source: /note="Description of Unknown: CsbCas7-11 sequence"
NYKFFNINGELMIPGSELRGMLRTHFEALTKSCFAIFGEDSTLSWRMN

SEQ ID NO: 578 - protein, 48 aa, Unknown
  source: /note="Description of Unknown: CjcCas7-11 sequence"
NYQFFHINDEIMVPGSEIRGMISSVYEAITNSCFRVYDETKYITRRLS

SEQ ID NO: 579 - protein, 48 aa, Unknown
  source: /note="Description of Unknown: CbfCas7-11 sequence"
TYDFFQMNNAIMIPGSEIRGMISAVYEAMTNSCFRIFHEKQYLTRRIS

SEQ ID NO: 580 - protein, 48 aa, Unknown
  source: /note="Description of Unknown: HvsCas7-11 sequence"
YYHFLKIDNKPIIPGAEIRGAVSSIYEALTNSCFRVFGEKKVLSWRME

SEQ ID NO: 581 - protein, 48 aa, Unknown
  source: /note="Description of Unknown: HsmCas7-11 sequence"
VYKFFRLGGHLCIPAAEIRGMISSVYEALTNSCFRVFDEKRLISWRMT

SEQ ID NO: 582 - protein, 48 aa, Unknown
  source: /note="Description of Unknown: FmCas7-11 sequence"
SFRFFRIDDEVLIPGSEIRGMVSTVFEALTGSCFRVINQKAHLSWRIN

SEQ ID NO: 583 - protein, 48 aa, Unknown
  source: /note="Description of Unknown: DpbaCas7-11 sequence"
RFKFMRMGSQAAIPGSAIRSMTSSVFEALTNSCFRVLDQKSHLSWRME

SEQ ID NO: 584 - protein, 21 aa, Unknown
  source: /note="Description of Unknown: WmCas7x3 sequence"
EALSAIGRIVERNGELKLYPL

SEQ ID NO: 585 - protein, 23 aa, Unknown
  source: /note="Description of Unknown: NisCas7x3 sequence"
DYVALSAMGRIVDDQGELKLQPL

SEQ ID NO: 586 - protein, 21 aa, Unknown
  source: /note="Description of Unknown: GwCas7x3 sequence"
QSLSAMGRIVRHDQKLYLLPL

SEQ ID NO: 587 - protein, 31 aa, Unknown
  source: /note="Description of Unknown: HvmCas7x3 sequence"
ANRNEDKPLSALGMIKKIETGDKVEYRLLPL

SEQ ID NO: 588 - protein, 22 aa, Unknown
  source: /note="Description of Unknown: DsbCas7x3 sequence"
SGSLSAIGMVVIRDGKKFIYPL

SEQ ID NO: 589 - protein, 23 aa, Unknown
  source: /note="Description of Unknown: GamCas7x3 sequence"
PSHILSALGMVTKRGEDFWLIPL

SEQ ID NO: 590 - protein, 21 aa, Unknown
  source: /note="Description of Unknown: DesCas7x3 sequence"
NALREIGMIVLRDGKRFILPL

SEQ ID NO: 591 - protein, 21 aa, Unknown
  source: /note="Description of Unknown: GabCas7x3 sequence"
RALRKIGILFKREEQWRLVQM

SEQ ID NO: 592 - protein, 21 aa, Unknown
  source: /note="Description of Unknown: MetCas7x3 sequence"
DALRKVGMVIYVDNKSFIIKL

SEQ ID NO: 593 - protein, 22 aa, Unknown
  source: /note="Description of Unknown: MebCas7x3 sequence"
LALSKIGITFINRQGQWQLIPM

SEQ ID NO: 594 - protein, 27 aa, Unknown
  source: /note="Description of Unknown: GwCas7-11 sequence"
DEAKYRKAGRVTVSGDGAQKKYSIQEM

SEQ ID NO: 595 - protein, 20 aa, Unknown
  source: /note="Description of Unknown: HreCas7-11 sequence"
DEFKDFHPGIVVDGAKIREM

SEQ ID NO: 596 - protein, 39 aa, Unknown
  source: /note="Description of Unknown: CmaCas7-11 sequence"
ESETTQKRKSGRYQVEESDPDLFPGRVQKKGNKYKIEKM

SEQ ID NO: 597 - protein, 25 aa, Unknown
  source: /note="Description of Unknown: HvmCas7-11 sequence"
DPTELTKYYPGKVKRDGNKFFILKM

SEQ ID NO: 598 - protein, 21 aa, Unknown
  source: /note="Description of Unknown: SmCas7-11 sequence"
EDYKDFYPGRVLDGGKQIKKM

SEQ ID NO: 599 - protein, 21 aa, Unknown
  source: /note="Description of Unknown: OmCas7-11 sequence"
SEHKDYQPGKITDNGRKIQPM

SEQ ID NO: 600 - protein, 24 aa, Unknown
  source: /note="Description of Unknown: DisCas7-11 sequence"
DHQNVLQDFLPGRVTADGKHIQKF

SEQ ID NO: 601 - protein, 23 aa, Unknown
  source: /note="Description of Unknown: DsbaCas7-11 sequence"
DVKELEQFKPGRVADDGKRIEEM

SEQ ID NO: 602 - protein, 23 aa, Unknown
  source: /note="Description of Unknown: SstCas7-11 sequence"
DRNVLMQFKPGRVTDNGLRIEEM

SEQ ID NO: 603 - protein, 27 aa, Unknown
  source: /note="Description of Unknown: SybCas7-11 sequence"
KKGAKSSELVPGIIVWGQNGGLAVQQV

SEQ ID NO: 604 - protein, 45 aa, Unknown
  source: /note="Description of Unknown: CsbCas7-11 sequence"
DEKDYKIDSNSIRKMESQRNPKYRIPDELQKELRNSGNGLFNRLY

SEQ ID NO: 605 - protein, 37 aa, Unknown
  source: /note="Description of Unknown: CjcCas7-11 sequence"
EKKDESNDKNKSQDDASQKIRKGLVKKTDEGFSIIEV

SEQ ID NO: 606 - protein, 25 aa, Unknown
  source: /note="Description of Unknown: CbfCas7-11 sequence"
EDKELREFIPGIVRIINGDVYIEKA

SEQ ID NO: 607 - protein, 23 aa, Unknown
  source: /note="Description of Unknown: HvsCas7-11 sequence"
KDAKEFMPGRVSKKKGKLYMVKM

SEQ ID NO: 608 - protein, 36 aa, Unknown
  source: /note="Description of Unknown: HsmCas7-11 sequence"
EEAKRPDPKKSEEQNRMRFRPGRIIKKDKKFYAQEM

SEQ ID NO: 609 - protein, 23 aa, Unknown
  source: /note="Description of Unknown: FmCas7-11 sequence"
DMAKHYRPGRIIQNNEKMFIQPY

SEQ ID NO: 610 - protein, 23 aa, Unknown
  source: /note="Description of Unknown: DpbaCas7-11 sequence"
DDAGDYKPGRFEKKDDKAVIRKF

SEQ ID NO: 611 - protein, 1291 aa, Unknown; identical to SEQ ID NO: 23
  source: /note="Description of Unknown: WmCas7x3 sequence"

SEQ ID NO: 612 - protein, 1437 aa, Nitrosomonas sp.
MTDTVKSGRWIITGQFQLVTPMHIGTGLDEEMDKQSGESVDKKQNNSWIQAIALDLNKKPYIPGASIKGALKALARRYYCASNLNIFGDTIDTKDGDNKRKSVTVAGQAEFLNAWYAADQEDKPFDTITRVAIDRVTGTAEDRKLFNTRRVNPGVCFNYKIIIQNACETEIQYLLDLLRKAAKDPSFSLGAGANQSQGKVRCLSSCVRYFGKQEMHDWFRAIQNGKQEHWQIFAKPSNIKYADLERPDIIANSLNLPLTLDFHTPFLVKASKKKDEAKNEADAKPRTNHQGQVILPASSLRGRLRAQAEKILRTMGQDIPQGHAAPAYDGIAHRDLISLLFGTAGWKGIVCASDLIHSIPEYALQFNGVRETISDLSDTVKSCIIVDLVKTSTAAEKTEEQLHIRIVDSAGSLIVHKSENSSWANDTFRDASVKDNFKARLKEIADPQDLSDALRADIKKRAFQLATLTRHEMVAIDRFTGGGKEGAKFNVDYIECPTLTGAIYLDLHRLKQAQLKNDEDALKPALGLISLLLRDLAEGDIAFGFGANKGYGQCREHAVLDNWEERLKKIGAGLTIDGALQALRDTVALEPPAEFPPEIEKTTDDNQPEAPDFNLKPASNGFHNPYHFIPLNNPKIGDWPEAKAETLKANREGHDQYHTGKFSGRIVCSLTTQTPLFIGAETKPSTSDREPSEARPFKLNGKHAIPATSLRGMLSSLFESVSNSNFRVLHPEHYSVRKSLDDYVALSAMGRIVDDQGELKLQPLTLPTLFGNRNNVPAKWEKIFGTPSEDDFLRIYFDDIPSKFSSNKRYFYNCKATELKDFIKSDKYFIGKRTPTVFPKSSTEKSHLESLEFIDVEKFKKAVENLEITPGNNPYIHGWVRNLKDEFREDIPDNVKHHVFLPDTTKRVSPLEIPPHVKKRFHELADLALAGLHLKQGETIASPYKILPYTPIGRNKLENHIHRVPNDLTCYMTRLKKGDLVFFDVDNDGQITEISFSSIWRAGIGTKNKLQTTADLLSQRDPNLVQLGMGVRTKNTDRFKLSPAERLFGVVEHRDDDNTTVENVNQPNDKAQAFAFAGKVRIGFGLPDKKTTVNGVSPVTLKELSSPKPPSPAFYLKRKNNDDFVSKKVAAECSETMTLRGRKCYLHAWREQNGNVMKLDAIGVNSGGSTCKPPWKTHKPAANDQKEFEEDKNKFITSRQVKIAPISENTPFYFEIDFNNLDATELAQLCATLQPAPKFEHRLGMGKPLGLGSVKIEPVGLFLINRHQRYTTDSTNCDRYHYAWLKGEHAAWDWPEYFRQNVVTADCTQTFNDTFDKLVQNGLAGTDADIKHALQLLGDPQYIGVPVHYPIAGNSTLENKHFEWFGNNDKASVLRQKAQANSKNHHYQPKQQATPEEPQYLHTITKDSKQISLLKKNKIEDIENRDQQKHRYSNHRR

SEQ ID NO: 613 - protein, 1237 aa, Unknown; identical to SEQ ID NO: 22
  source: /note="Description of Unknown: GwCas7x3 sequence"

SEQ ID NO: 614 - protein, 1276 aa, Unknown; identical to SEQ ID NO: 30
  source: /note="Description of Unknown: Gammaproteobacteria bacterium sequence"

SEQ ID NO: 615 - protein, 1221 aa, Methylobacter tundripaludum
MNLPTWKLNNEKRWHISIVLTTATPLHIGSGEFCEHDDVKNNDGEPVKINACIKGSKGRPIIPGSTIKGKLYEWLKTRNTEENLLEKLFGKGHNSVSQDQGRGGKAEFHDAEIIEPLTGSQPWPYWREEHQAFIAASTAIDRHKQVALQQSLHYMETVPAGIRFKFTFTGVMRDEEAALLIAALDSFDKNQNQPCFGVDRANAYGRMELHGHLHVKVMGATEISSWLNSFSENDKKMAMESARNLEQQEINTLIEQGNALFKASCDEVKLGLTLKFKGPFLVNDPYAVKILSSNENAKTDHYPLLDKNRNPYLPVSSFRGVLRSQAERIIRTLGGKCCSTDDPCKPIFDKGDLSKLCLACQIFGASGWKTVINIHDFKAINKSKKTKQDFVAIDRFHGGGKDGAKFDATHFERPEFEGAISFSPRMANNDLDWGKGLLALVLRDMQEGDMTFGYGANKGYGGLESASITGIEQITSDIQAFRDKCVASPQTWLCDEAVKPANQQDKIPPAGIQVANSGFHNPYQFIPSKEPDTGHWLPVLGLNADSHHSHAFYRDQTDNGEKLYHGRLICCLNTETPIFIGADKKKDTEPAEINNYRLNGELAIPATSLRGMISSLAEAASNSAMRVLDNGLLSYRKTADDALRKVGMVIYVDNKSFIIKLNDAIKLKQTYTPGNMKDFIEKSNSWSPEHNTVYYLDNNQIPQESYMNGMKPGILRILGKEGREQELENKLHELFIPVPLEYVDTENNKFDYQAYKKAFLYRAIEIPEPVLKRYSELADQRTMSQKSNKELKKDDTCQSVGWLPFHLKGTKRQLDDKHNVGKLQIDEYDLIYYEASGKEVTEVAFSSIWRGRVETNSSQANKVYSFIPGELLPFNESRKKVSPAELLFGFTQINKDGSKADDKAQAFAGKVRISAGTISEYPENEANLLEQEVTLKALSTPKLPSPALYFRTINGNGSAYISKQELEPSKHLAKGRKYYLHALRTGDNKVQKLGSQGETANGGDSKLPWVTHNPDERPQLKVKIKPIKAEFIFSLDFNNLTEWELGLLCYALRPTDSFRHRIGMGKPLGLGSVKIDIMALQTINRQQRYAQDGLEENRFNRHNWVNPPHQPRLEKAGYSISLSSTPLNPEILRATFTKTMNADIYRTLELLGNPQNVKRPVHYPQVENHNIEQENYKWFVANDQGSGKGRNKIDPAEKALKILTENSDCLPTLSRLDWRDE

SEQ ID NO: 616 - protein, 1225 aa, Desulfobulbus sp.; identical to SEQ ID NO: 26

SEQ ID NO: 617 - protein, 1720 aa, Unknown; identical to SEQ ID NO: 19
  source: /note="Description of Unknown: HreCas7.11 sequence"

SEQ ID NO: 618 - protein, 1657 aa, Unknown; identical to SEQ ID NO: 4
  source: /note="Description of Unknown: CmaCas7.11 sequence"

SEQ ID NO: 619 - protein, 1723 aa, Unknown; identical to SEQ ID NO: 17
  source: /note="Description of Unknown: HvmCas7.11 sequence"

SEQ ID NO: 620 - protein, 1575 aa, Unknown; identical to SEQ ID NO: 21
  source: /note="Description of Unknown: SmCas7x3 sequence"

SEQ ID NO: 621 - protein, 1801 aa, Unknown; identical to SEQ ID NO: 24
  source: /note="Description of Unknown: oral_meta sequence"

SEQ ID NO: 622 - protein, 1601 aa, Unknown; identical to SEQ ID NO: 5
  source: /note="Description of Unknown: DisCas7.11 sequence"

SEQ ID NO: 623 - protein, 1659 aa, Unknown; identical to SEQ ID NO: 3
  source: /note="Description of Unknown: DsbaCas7.11 sequence"

SEQ ID NO: 624 - protein, 1652 aa, Unknown; identical to SEQ ID NO: 16
  source: /note="Description of Unknown: SstCas7.11 sequence"

SEQ ID NO: 625 - protein, 1717 aa, Unknown; identical to SEQ ID NO: 2
  source: /note="Description of Unknown: CsbCas7.11 sequence"

SEQ ID NO: 626 - protein, 1812 aa, Unknown; identical to SEQ ID NO: 1
  source: /note="Description of Unknown: CjcCas7.11 sequence"

SEQ ID NO: 627 - protein, 1573 aa, Unknown; identical to SEQ ID NO: 6
  source: /note="Description of Unknown: CbfCas7.11 sequence"

SEQ ID NO: 628 - protein, 1528 aa, Unknown; identical to SEQ ID NO: 15
  source: /note="Description of Unknown: HvsCas7.11 sequence"

SEQ ID NO: 629 - protein, 1548 aa, Unknown; identical to SEQ ID NO: 18
  source: /note="Description of Unknown: HsmCas7.11 sequence"

SEQ ID NO: 630 - protein, 1610 aa, Unknown; identical to SEQ ID NO: 20
  source: /note="Description of Unknown: FmCas7.11 sequence"

SEQ ID NO: 631 - protein, 1526 aa, Unknown; identical to SEQ ID NO: 7
  source: /note="Description of Unknown: DpbaCas7.11 sequence"

SEQ ID NO: 632 - protein, 1329 aa, Unknown
  source: /note="Description of Unknown: Syntrophorhabdaceae bacterium sequence"
MFPKGRQMRRQRLLGDAEYYGGTGREQPASIVISTDSDPDHKVYEWIITGQLKAETGFFFGTKAGAGGHTDLSILLGKDGHYRVPRSVFRGALRRDLRVAFGAGCRVEVGRERPCECPVCKVMRQITVMDTISSYREAPEIRQRIRLNPYTGTVDKGALFDMEVGPEGIEFPFVLRFRGSKSFPSELAAVIGSWTKGTAWLGGAAATGKGRFSLLGLSIHKWNLSTAEGRKSYLAAYGLRDAADKTVKRLSIDKGGKGDVGLPAGLERDALPSSVREPLWKKLVCTVDFSSPLLLADPIAALLGVEGDERIGFDNIAYEKRRYNGETNTTESIPAVKGETFRGIVRTALGKRHGNLTRDHEDCRCRLCAVFGKEQEAGKIRFEDLMPVGAWTRKHLDHVAIDRFHGGAEENMKFDTYALAASPTNPLRMKGLIWVRSDLFETGHDGPTPPYVKDIIDALADVKRGLYPVGGKTGSGYGWIKDVTIDGLPQGLSLPPAEERVDGVNEVPPYNYSAPPDLPSAAEGEYFFPHVFIKPYDKVDRVSRLTGHDRFRQGRITGRITCTLKTLTPLIIPDSEGIQTDATGHKMCKFFSVAGKPMIPGSEIRGMISSVYEALTNSCFRVFDEEKYLTRRVQPKKGAKSSELVPGIIVWGQNGGLAVQQVKNAYRVPLYDDPAVTSAIPTEAQKNKERWESVPSVNLQGALDWNLTTANIARDNRTFLNSRPEEKDAILSGTKPISFELEGTNPNDMLVRLVPDGVDGAHSGYLKFTGLNMVLKANKKTSRKLAPSEEDVRTLAILHNDFDSRRDWRRPPNSQRYFPRSVLRFSLERSTYTIPKRCERVFEGTCGEPYSVPSDVERQYNSIIDDISKNYGRISETYLTKTANRKLTVGDLVYFIADLDKNMATHILPVFISRISDEKPLGELLPFSGKLIPCEGEPPTILKKMAPSLLTEAWRTLISTHLEGFCPACRLFGTTSYKGRIRFGFAEHTGTPKWLREELDWARPFLTLPIQERPRPTWSVPDDKSEVPGRKFYLHHHGGNRIVESNLRNRPEVNQTKNNSSVEPISAGNTFTFDVCFENLEAWELGLLLYCLELSPKLAHKLGRAKAFGFGSVKIHVERIEERTTDGAYQDVTAVKKNGWITTGHDKLREWFHRDDWEDVDHIRNLRTVLRFPDADQEHDVRYPELKANNGVSGYVELRDKMTASERQESLRTPWYRWFPQNGTGGSGRHEQAATSQEQDTAKDESVLSATQRRQAVIDVSDPDERLSGTVESFDRQKGDGYIGCGVRQFYVRLEDIRSRTALCEGQVVTFRARKEWEGHEAYDVEIDQ

SEQ ID NO: 633 - RNA, 45 nt, Artificial Sequence
  source: /note="Description of Artificial Sequence: Synthetic oligonucleotide"
  modified_base (15)..(45): a, c, u, g, unknown or other
ugaugucacggaacnnnnnnnnnnnnnnnnnnnnnnnnnnnnnnn

SEQ ID NO: 634 - RNA, 35 nt, Artificial Sequence
  source: /note="Description of Artificial Sequence: Synthetic oligonucleotide"
gguuggaaagccgguuuucuuugaugucacggaac

SEQ ID NO: 635 - DNA, 54 bp, Artificial Sequence
  source: /note="Description of Artificial Sequence: Synthetic oligonucleotide"
  modified_base (10)..(15): a, c, t, g, unknown or other
  modified_base (47)..(52): a, c, t, g, unknown or other
ctagaaatannnnnntggattacttggtagaacaccaatctactcgnnnnnnac

SEQ ID NO: 636 - DNA, 31 bp, Artificial Sequence
  source: /note="Description of Artificial Sequence: Synthetic oligonucleotide"
cgagtagattggtgttctaccaagtaatcca

SEQ ID NO: 637 - RNA, 36 nt, Artificial Sequence
  source: /note="Description of Artificial Sequence: Synthetic oligonucleotide"
guuuggaagccgggucgaagucaggcccguuaagac

SEQ ID NO: 638 - RNA, 36 nt, Artificial Sequence
  source: /note="Description of Artificial Sequence: Synthetic oligonucleotide"
cuugaagacuaaaggaaggaauuaaugucacgguac

SEQ ID NO: 639 - RNA, 45 nt, Artificial Sequence
  source: /note="Description of Artificial Sequence: Synthetic oligonucleotide"
auugaaugcagaguagaggccgcaggauaguuuagaacauucuau

SEQ ID NO: 640 - DNA, 46 bp, Artificial Sequence
  source: /note="Description of Artificial Sequence: Synthetic oligonucleotide"
  source: /note="Description of Combined DNA/RNA Molecule: Synthetic oligonucleotide"
gttgatgtcacggaacucuaaaccauccugcggccucuacucugca

SEQ ID NO: 641 - DNA, 101 bp, Artificial Sequence
  source: /note="Description of Artificial Sequence: Synthetic polynucleotide"
ggttggaaagccggttttctttgatgtcacggaacctttgttgtcttcgacatgggtaatcctcatggttggaaagccggttttctttgatgtcacggaac

SEQ ID NO: 642 - DNA, 65 bp, Artificial Sequence
  source: /note="Description of Artificial Sequence: Synthetic oligonucleotide"
gttggaaagccggttttctttgatgtcacggaaccgagtagattgctgttctaccaagtaatcca

SEQ ID NO: 643 - DNA, 46 bp, Artificial Sequence
  source: /note="Description of Artificial Sequence: Synthetic oligonucleotide"
ttgatgtcacggaacctttgttgtcttcgacatgggtaatcctcat

SEQ ID NO: 644 - RNA, 37 nt, Artificial Sequence
  source: /note="Description of Artificial Sequence: Synthetic oligonucleotide"
  modified_base (16)..(37): a, c, u, g, unknown or other
uuaaugucacgguacnnnnnnnnnnnnnnnnnnnnnn

SEQ ID NO: 645 - DNA, 50 bp, Artificial Sequence
  source: /note="Description of Artificial Sequence: Synthetic oligonucleotide"
caggttcctggaactggaatctctttccatagaatgttctaaaccatcct

SEQ ID NO: 646 - DNA, 50 bp, Artificial Sequence
  source: /note="Description of Artificial Sequence: Synthetic oligonucleotide"
accaggttcctggaactggaatctctttccatagaatgttctaaaccatc

SEQ ID NO: 647 - DNA, 50 bp, Artificial Sequence
  source: /note="Description of Artificial Sequence: Synthetic oligonucleotide"
gtaccaggttcctggaactggaatctctttccatagaatgttctaaacca

What is claimed is:

1. A composition that cleaves an RNA target comprising a guide RNA that hybridizes to the RNA target, and a polypeptide comprising an amino acid sequence 85-100% identical to the amino acid sequence of SEQ ID NO: 1,
wherein the polypeptide comprises a glutamate at a position corresponding to position 70 of SEQ ID NO: 1; and/or aspartate at a position corresponding to position 429 of SEQ ID NO: 1; and/or aspartate at a position corresponding to position 487 of SEQ ID NO: 1; and/or an aspartate at a position corresponding to position 654 of SEQ ID NO: 1.

2. The composition of claim 1, wherein the polypeptide comprises an amino acid sequence at least 90% identical to the amino acid sequence of SEQ ID NO:1.

3. The composition of claim 1, wherein the polypeptide comprises an amino acid sequence at least 95% identical to the amino acid sequence of SEQ ID NO:1.

4. The composition of claim 1, wherein the polypeptide comprises an amino acid sequence at least 99% identical to the amino acid sequence of SEQ ID NO:1.

5. The composition of claim 1, wherein the guide RNA has a sequence with a length of from about 20 to about 53 nucleotides (nt), or from about 25 to about 53 nt, or from about 29 to about 53 nt, or from about 40 to about 50 nt.

6. The composition of claim 1, wherein the guide RNA is a pre-crRNA.

7. The composition of claim 1, wherein the guide RNA is a mature crRNA.

8. The composition of claim 1, wherein the RNA target is a single-strand RNA (ssRNA).

9. A composition that cleaves an RNA target comprising a guide RNA that hybridizes to the RNA target, and a polynucleotide that encodes a polypeptide comprising an amino acid sequence 85-100% identical to the amino acid sequence of SEQ ID NO: 1,
wherein the polypeptide comprises a glutamate at a position corresponding to position 70 of SEQ ID NO: 1; and/or aspartate at a position corresponding to position 429 of SEQ ID NO: 1; and/or aspartate at a position corresponding to position 487 of SEQ ID NO: 1; and/or an aspartate at a position corresponding to position 654 of SEQ ID NO: 1.

10. The composition of claim 9, wherein the guide RNA is encoded by a nucleic acid molecule.

11. A vector comprising the polynucleotide of claim 9.

12. An isolated cell comprising the composition of claim 1.

13. The isolated cell of claim 12, wherein the isolated cell is an isolated prokaryotic cell or an isolated eukaryotic cell.

14. The isolated cell of claim 13, wherein the isolated eukaryotic cell is an isolated mammalian cell.

15. The isolated cell of claim 13, wherein the isolated mammalian cell is an isolated human cell.

16. A method of cleaving an RNA target in a cell in vitro comprising providing to the cell the composition of claim 1.

17. The method of claim 16, wherein the RNA target is an ssRNA.

* * * * *